United States Patent 9,315,822 (GENES AND USES FOR PLANT IMPROVEMENT) - sequence listing, part 5

SEQ ID NO: 18167 - protein, 523 aa, Aspergillus saitoi
MRITSAIASLLLVGTATSLQNPHRRAVPPPLTHRSVASRAVPVERRSNDFEYLTNKTARFLVNGTSIPEVDFDVGESYAGLLPNTPTGNSSLFFWFFPSQNPDASDEITIWLNGGPGCSSLDGLLQENGPFLWQPGTYKPVPNPYSWTNLTNVVYIDQPAGTGFSPGPSTVNDEEDVAAQFNSWFKHFVDTFDLHGRKVYITGESYAGMYVPYIADAMLNEEDTTYFNLKGIQINDPSINSDSVMMYSPAVRHLNHYNNIFRLNSTFLSYINGKADKCGYNAFLDKAITYPPPTPFPTAPEITEDCQVWDEVVMAAYDINPCFNYYHLIDFCPYLWDVLGFPSLGFGPDNYFNRSDVQKILHVPPTDYSVCSETVIFANGDGSDPSSWGPLPSVIERTNNTIIGHGWLDYLLFLNGSLATIQNMTWNGKQGFQSPPVEPLFVPYHYGLAELYWGDEPDPYNLDAGAGYLGTAHTERGLTFSSVYLSGHEIPQYVPGALTASWSSCLVELIVFPRRGTTPLNFS

SEQ ID NO: 18168 - protein, 468 aa, Burkholderia thailandensis E264
MQKGSAETDLHRGLGQRQMRLIALGAAIGVGLFLGSANAIKMAGPGIILSYIIGGAVIFVIMRALGEMAVHEPVAGSFSRYARNYLGPLAGYLTGWNYWFLWLVTCIAEITAVGIYMGIWFPDVPRWIWALAALATMGSVNLLTVKAYGEFEFWFALIKVVTIVVMIAVGIAMIALGIGNHGVPMGISNLWAHGGFFPNGAQGVLMSMQMVMFAYLGVEMIGLTAGEAENPQKTIPGAINSVFWRILLFYGGALFVILSIYPWNEIGTQGSPFVMTFERLGIKTAAGIINFVVLTAALSSCNGGIFSTGRMLYNLAQQGHAPRTFGETTASGVPRRAILVSMAALLVGVLLNYLVPEKVFVWVTSISTFGAIWTWGVILVAQMKFRASLAPAQERALRFRMPFWPYGSWVALTFLVLVVGLMAYFPDTRIALYVGPAWLVLLVVLYYALKLEPEGGKEAGLARGYERG

SEQ ID NO: 18169 - protein, 314 aa, Anabaena variabilis ATCC 29413
MASPTLRANRTFQERGVWGEVIEFTLIYLKKIRGAAMLGDLKIAFIGGGTMGEMIISRLLSTKTVEKSELIIVSEPYSTRCLYLEKEYGVHTTNCNIEAVQGASIVILAVKPQVLPEVMAVLKDQIPPDALVISIVGGASVSSLCQGLNHGAVVRTMPNIAVQVGHGTTVWSASSNVTEIQRSHTQIILQALGKEFVTQNEHYLDMATALSSAGTGFVFLYIEAMIDAGVQMGLTRIQAQELTLHTIAGSVELMLQTNEHPAVLRNKVTSPGGVTAAGIYELEKGGMRTSISNAFSTALSRTQQLGNISCSISG

SEQ ID NO: 18170 - protein, 228 aa, Arabidopsis thaliana
MLSFHLSRCFTFRQVRDSVRKSNFSEIPVGSVCVSDIQLKGRGRTKNVWESPKGCLMYSFTLEMEDGRVVPLIQYVVSLAVTEAVKDVCDKKGLSYNDVKIKWPNDLYLNGLKIGGILCTSTYRSRKFLVSVGVGLNVDNEQPTTCLNAVLKDVCPPSNLLKREEILGAFFKKFENFFDLFMEQGFKSLEELYYRTWLHSGQRVIAEEKNEDQVVQNVVTIQLLEMTM

SEQ ID NO: 18171 - protein, 438 aa, Bacillus cereus G9241
MHHDEKNKIGLTVALSIVVGTIIGSGVFMKPGSVLDYSGSSNMAILAWVIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISENQSIGMAILATLFAYDGWILLASIGGEMKNPTKLLPKAMTVGILIVTAAYVLINLALLNVLPATQIVDLGENATATAAGMLLGEYGGKIISIGIIVSIFGCLNGKILTFPRIPMSMAERGQLPFAKFIAKESPRFKTPANAITVEIILGIILMIISDPNKLSEISVFIIYIFYVMTFIGVFILRKRNKNKERAYSVPLFPIVPIVAILGSFFVIGSAIINDPISCFLSIGIVFTGLPVYWYLNKKNKNEVS

SEQ ID NO: 18172 - protein, 384 aa, Triticum aestivum
  misc_feature (74)..(74): Xaa can be any naturally occurring amino acid
  misc_feature (307)..(307): Xaa can be any naturally occurring amino acid
  unsure (1)..(384): unsure at all Xaa locations
MSAFVGKYADELIKTAKYIATPGKGILAADESTGTIGKRLASINVENVESNRQALREMLFTAPGALEYLSGVIXLFEETLYQTAADGTPFVDILKAGNVIPGIKVDKGTVDIAGTNGETTTQGLDSLGARCAKYYEAGARFAKWRAVLKIGPGAEPSELAVKQNAQGLARYALICQENGLVPIVEPEILTDGPHDIKACAAATERVLAAVYKSLNDHKVLLEGTLLKPNMVTPGSDSPKVGAEVIAEYTVAALRRTVPPAVPGVVFLSGGQSEEQATQNRDAMNKLPVLKPWALTSPSGRALQQSTXKKWARKKENLADAQAPFLARCKALRGTSEVRGRATAAGTRRVETAVGQYKHVLRHPDQIREPFLDGGMPDSSLKASY

SEQ ID NO: 18173 - protein, 962 aa, marine gamma proteobacterium HTCC2207
MENIKMLQKTRSLTDLENAAEFIARHIGPSADDQQKMLSSLGCSSLQELTSQVVPEAIAMTQALDIVDGCSEAQALAELREIAAHNKVFRSFIGQGYYNTITPNVVQRNILENPAWYTAYTPYQPEISQGRLEALINFQTMITDLTGMEMSNASMLDEGTAAAEAMSLCQRMSKSKSLRFFVDSDCLPQTIDVIKTRAEPVGIEVIVGNPDQLPEDLFGALFQYPGASGEVRNFRDVIQQVQQQGALVVMAADILSLVLLESPGSLGADVVIGSTQRFGVPLGFGGPHAAYMSTREAYKRNLPGRLVGLSQDANGEPAYRLALQTREQHIRREKATSNICTAQVLLAVIAGMYAVYHGPEGLQRIARRVNLMTSVLAQGLALHGIKPINNHWFDTLTLDTGARTEEILQVAAAHEVNLRRIDENTLGVSLDETVTRSDINLLWTILIGEHQIDIDDLADQAVDSLPGELMRTESFLTHPTFNRYHSETEMLRYLRKLSDKDIALDRAMIPLGSCTMKLNATAEMLPITWPEFSTMHPFAPTDQTQGYRLMIDQLEDMLCASTGYDAMSLQPNAGSQGEYAGLLAIRGYHESRGDTDRDICLIPSSAHGTNPASAQMCGMKVVVVKCDDQGNVDVDDLIAKAELHSAKLSAIMVTYPSTHGVFEERIGEICEIVHDHGGQVYIDGANLNAMVGVCQPGKFGGDVSHLNLHKTFCIPHGGGGPGVGPIGVGAHLAPFMPRETADGERQGAKVSAAPYGSASILPITWMYIRMMGRSGLKQATEMAILNANYIATRLQDDYEILYTGAQGRIAHECILDVRSIKDDVGISVDDIAKRLIDFGFHAPTMSFPVAGTLMIEPTESESKAEIDRFCDAMIAIKHEINQVAAGQLDLADNPLVHAPHTAEVVGADEWTRSYSRSQAAYPLRSLRENKYWPPVGRLDHVFGDRNLICSCPSISDYETDEV

SEQ ID NO: 18174 - protein, 176 aa, Triticum aestivum
  misc_feature (71)..(71): Xaa can be any naturally occurring amino acid
  misc_feature (87)..(87): Xaa can be any naturally occurring amino acid
  misc_feature (99)..(99): Xaa can be any naturally occurring amino acid
  misc_feature (123)..(123): Xaa can be any naturally occurring amino acid
  unsure (1)..(176): unsure at all Xaa locations
MGPTVMASSATFVTPFQGLKSTVGLPVSRRSNGASLGSVSNSGRIRCMQVWPIEGIKKFETLSYLPPVSTXEALLNQDHYLIRSKWXPCLQFIKGGFIXREHNASAVYYHGRYWTMWKLSMFXCTDSTQVINQVEEVKKEYPDAYVRIIGFDNMRQVQCVSFIAFKPPGCEESGKA

SEQ ID NO: 18175 - protein, 181 aa, Arabidopsis thaliana
  misc_feature (39)..(39): Xaa can be any naturally occurring amino acid
  unsure (1)..(181): unsure at all Xaa locations
MASSMFSSTAVVTSPAQATMVAPFTGLKSSASFPVTRQXNNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 18176 - protein, 160 aa, Ustilago maydis 521
MMRNSTVTAARSVRARCTPATILGTTRVRTLTSSGSRRSANVVASSTSEQEQITAGEQKIRELLTTKFQPSMLKVQDVSGGCGSFYAIQLSSKQFNGLSTVKAHRMVNEQLKHVIKDIHGLQPSSIDLMAADKFPPIHLTISSRAVAHHARRLANNHVQA

SEQ ID NO: 18177 - protein, 248 aa, Zea mays
MGRPTAGHPSPYMPPPSPWMNQRPLGVDVNVAYVEGREDPDRGVQPQPLTQDFLMMSSGKRKRDEYPGQLPSGSFVPQQDGSADQIVEFVVSKENANQLWSSIGNKLETPTKTITPVIPQRDGIQDNYNDQFFFSGVPTEDYNTPGESAEYRAPTPAVGTPKQRNDAGDDDNDDDDDEPPLNEDDDDEDDLDDLEQGEDEPNTQHLVLAQFDKVTRTKNRWKCTLKDGIMHLNGRDVLFNKATGEFDF

SEQ ID NO: 18178 - protein, 291 aa, Salinibacter ruber DSM 13855
MTTSPHVSTDVPPADRHARTPPVTATLLGTGTSTGVPVIGCDCEVCTSADPRDTRTRCACYVEVGDMGLLIDTGPDFRAQALREDIDRIDAVCYTHHHFDHVVGLDDLRPYFRDNRRVMPCYAHAETAAVLRRNYDYVFGGDPYPGAANVELEVVDGPFRVPSRTAADTAVPVDPILLMHGDVPVYGYRLGRFAYLTDASAIPEASYEQLQGIDTLVLDGLRPRPHPTHFSFDEAVAAARRIGARETYLVHMTHDVRHAEAEAALPDDVHLAHDGLTLEVPAYDSAGQDER

SEQ ID NO: 18179 - protein, 397 aa, Zymomonas mobilis
MKPKLPLNRRQNPVRIMFLRLLSEQPQVKRRPLSRPMISQQQWPNWMLPRRLWQPMMINMLSVLSVMIELKSKGVDIITLGAGEPDFETPEFIKEAAIQAIHDGKTRYTNVDGTAELKEAIVGKFRRDNHLEYRTDQISVGSGGKHVLFNALTATIDQGDEVIIPAPYWVSYPDIVRFCGGTPVFIQATIDQDYKITAEQLEKAITQKTRWFIFNSPSNPTGAAYSADEIKSLAEVLRRHPHVWILSDDIYEHIVFDNFRFATIAEVAPDLFDRTLTANGCSKAYAMTGWRIGFAGGPTPLIKAMAKLQSQSTSNPCSISQAAAVAALNGPQDFLQGWSDDFARRRNLVVDGLNAIEGISCPKPQVPSMSIRAFPSLLARKPHQVKSLKKTWISQAI

SEQ ID NO: 18180 - protein, 84 aa, Arabidopsis thaliana
MSSFTSKFADELIANAAYIGTPGKGILAADESTGTIGKRLASINVENVESNRRALRELLFTTPGALPCLRGGILFEETLYQKSF

SEQ ID NO: 18181 - protein, 588 aa, Synechococcus sp. RS9917
MALIDLTRRTKIVATIGPATESPERIRELIQAGATTFRLNFSHGDHSEHATRIATIRQVASELSQHIGILQDLQGPKIRLGRFALGPITLAKGDAFALTSRSVSCDQQIATVTYDKLAAEVSAGSRILLDDGRVEMKVERVDQAEQTLHCTVTVGGVLSNNKGVNFPDVQLSVRALTEKDRIDLAFGLQQGVDWVALSFVRNPSDMQEIRELIRQHGFSTPVVAKIEKFEAIDQIDAILPLCDGVMVARGDLGVEMPAEEVPLLQKELIQKANSLGIPIITATQMLDSMASSPRPTRAEVSDVANAILDGTDAVMLSNETAVGDYPIEAVETMATIARRIERDYPQRSIDSHLPSTIPNAISSAVSTIASQLNAAAILPLTKSGATAHNVSKFRPAAPILAITSEVAVARKLQLVWGVTPLVIAQQSTTSGTFTTAMAAAQDKGLLKEGDLVIQTAGTLAGVAGSTDLVKVGIVSAVLGQGTGVGQGTVSGRVRLAQCPGDACKIERGEILVVHDTTADDVDAIRDAAAVITEVPAATSHAALIAQRLGTPLIAGVAHATRHLLEGEVVTLQIKDGLVHRGTSINTAL

SEQ ID NO: 18182 - protein, 387 aa, Candidatus Pelagibacter ubique HTCC1002
MKLAKNLQRLGTESAFSVLAEAKKLEAQGKPMIHLGLGQPDFKTPQHVVDAAKKALDEGHHGYVLSNGILECRQAVTRKIKKLYNKDIDPERVLIMPGGKPTMYYAIQCFGEPGAEIIHPTPAFPIYESMINYTGSTPVPYDLTEDKDLKFDPEKILSLITDKTRLLILINPNNPTGSFVEKSAIDVLAEGLKKHPHVAILSDEIYSRQIYDGKEMPTFFNYPDLQDRLIVLDGWSKAYAMTGWRMGWSVWPEELIPHVNKLIINSVSCVNAPSQFAGIAALDGPDDAIHEMMVKFDQRRKLIHEGLNSLPGVECSLPGGAFYAFPKVIGTGMNGSEFAKKCMHEAGVAIVPGTAFGKTCQDYVRFSFAASQDNISNALENIKKMLG

SEQ ID NO: 18183 - protein, 250 aa, Triticum aestivum
  misc_feature (212)..(212): Xaa can be any naturally occurring amino acid
  misc_feature (229)..(229): Xaa can be any naturally occurring amino acid
  unsure (1)..(250): unsure at all Xaa locations
MSSSSKLFQSACKAARSFLASSSAPAAAPRAASSVLADGRNAALATLANLGRNSTLPGGYAHHLHTNAAASSHAYAWLAAIPAAVYMLQDQEVHAAEMERTFIAIKPDGVQRGLISEIVSRFERKGYKLVAIKLVVPSKQFAEKHYHDLKERPFFNGLCDFLSSGPVLAMVWEGEGVIKYGRKLIGATDPSKSEPGTIRGDLAVVVGRNIIXHGSDGPETAKDEIALWXFQPKELVSYTSNEEKWIYGVN

SEQ ID NO: 18184 - protein, 332 aa, Arabidopsis thaliana
MATSTTMSHQAIGSVVSQRPFKASQFLKEPLNNVPMKFRQKRFKIEATASQISVVDNTFLSPSPSKNKPHESKKKSNEAALILIRHGESLWNEKNLFTGCVDVPLTQKGVGEAIEAGKKISNIPVDLIFTSSLIRAQMTAMLAMTQHRRKKVPIILHNESVKAKTWSHVFSEETRKQSIPVIAAWQLNERMYGELQGLNKKETAERYGTQQVHEWRRSYEIPPPKGESLEMCAERAVAYFEDNIKPELASGNNVMIAAHGNSLRSIIMYLDDLTSQEVTTLDLSTGVPLLYIFKEGKFMKRGSPVGSTEAGVYAYTKRLAQYREKLDAAATI

SEQ ID NO: 18185 - protein, 476 aa, Burkholderia thailandensis E264
MNIHPVILCGGSGTRLWPMSRGGYPKQYLKLAGNTTLVQQTALRVRDVEGVGAPIVVTNNEQRFLVAEQLRQVGITPSSIVLEPMGRNTAPAIAIAALLALRESPDALLLVLPSDHVIDNETAFVDVVKTAASVASDAHLVTFGVTPTQAHTGYGYIRRGEAFAGDTRVYRVDAFVEKPDAPAAERFIADGGYYWNSGMFMLKASTYLDELRRHAPDIANQAELALGAAKRDHDFLRLDPEAFGASPNVSIDYAVMEKTERAAVVAAANLGWNDIGSWSALADIAATDARRNALIGDVYTDAVENSYIRAEHRMVAALGLDNIVIVETADAVLVAHRDRAQDVKKVVEWLNASGRRESVTHRRVIRPWGAYEGIDQGERFQVKRIVVDPGAQLSLQMHHHRAEHWIVVKGTALVTNDGKEIILTENQSTYIPLGTTHRLKNPGKIPLELIEVQSGSYLGEDDIVRFEDTYGRTSAT

SEQ ID NO: 18186 - protein, 440 aa, Arabidopsis thaliana
MEIDSEKIHERKQSDYNSLDERFEIQKEMYRGQQYSQIYFARLHLMRTLLYSLAPTWKSHLPVCKVLGLEKGKECIIVGTLFKHMKLKPCVLDEYSKERSVTPLVKPHNFMHPDDNLILEDESGRVKLAGSALSPAIYVTGVVVALHGKETNAGEFFVEDVLEAGLPPQIERPIDLQEDKYVVLLSGLCIGSKSANPLQFQLLVDHITGHLGDEEEQGLAAQIVHVVIAGNSFEFPRKLINGQNLASKDQSTLYEPIKELDIMLSQIAAGVSVDIMPGTNDPANFALPQQPLNRCLFPGSSPYNTFRSCTNPHSFDVDNIRFLGTSGQNIDDLGKYSEAKSKLDFVERTLRWRHLAPTAPNTLGCYPFTDRDPFLIETCPHVYFVGNQDKYDNRLIKGSEGQLVRLICIPKFCETGIAVAVNLRNLECHTLSFSTQINQS

SEQ ID NO: 18187 - protein, 377 aa, Oceanobacter sp. RED65
MDLLARAKQFQAEGRDIIHLEVGEPDFPSLPCVISAGQQALANGHTHYTPALGLPQLRQVIAQYYKSRYQVDVDWNRIVITPGASGALQLVTTLLLDESDQIMLADPGYPCNRHFAAVVNAQAQEVVTSAKDDFHLTALQVSQHWQKQTKAVMVATPSNPTGAVMNLQQLQDLQTAIKQQRGVLIVDEIYQGLVFDSAKDITALQLSGDQSNLFVINSFSKYFAMTGWRLGWMVAPEWAMEGLDRLAQNIFLAANTPAQHAALAVFEKEALQQLDERKTELQKRRDFLLPELIKLGFDVVAEPEGAFYIFARISHFNHRHAKDSMAFCLDLLEKTGVAITPGVDFSPSHGHEYVRFAYTQPISELQRAMDKIKHYLM

SEQ ID NO: 18188 - protein, 1000 aa, Vicia faba
MTMRFHPNSTAVTESVPRRGSVYGFIGYRSSSLFVRTNVIKYRSVKRNLEFRRRSAFSVKCGSGNEAKQKVKDQEVQQEAKTSPSSFAPDTTSIVSSIKYHAEFTPLFSPEKFELPQAFIATAQSVRDALIINWNATYDYYEKLNVKQAYYLSMEFLQGRALLNAIGNLELTGPYAEALSQLSYKLEDVAHQEPDAALGNGGLGRLASCFLDSLATLNYPAWGYGLRYKYGLFKQRITKDGQEEVAEDWLEMGNPWEIVRNDVSYPVRFYGKVVSGSDGKKHWVGGEDIKAVAHDVPIPGYKTRSTINLRLWSTKAASEEFDLNAFNSGRHTEASEALANAEKICYILYPGDESIEGKTLRLKQQYTLCSASLQDIIARFERRSGASVNWEDFPEKVAVQMNDTHPTLCIPELMRILIDIKGLSWKDAWNITQRTVAYTNHTVLPEALEKWSMDLMEKLLPRHVEIIEMIDEELIRTIIAEYGTADSDLLDKKLKEMRILENVELPAEFADILVKTKEATDISSEEVQISKEGGEEEETSKEGGEEEEEKEVGGGREEGDDGKEDEVEKAIAEKDGTVKSSIGDKKKKLPEPVPVPPKLVRMANLCVVGGHAVNGVAEIHSEIVKDDVFNAFYKLWPEKFQNKTNGVTPRRWIRFCNPDLSKIITQWIGTEDWILNTEKLAELRKFADNEDLQTQWREAKRNNKVKVAAFLRERTGYSVSPDSMFDIQVKRIHEYKRQLLNIFGIVYRYKKMKEMNAAERKENFVPRVCIFGGKAFATYVQAKRIVKFITDVGATVNHDPEIGDLLKVIFVPDYNVSVAEMLIPASELSQHISTAGMEASGTSNMKFAMNGCLQIGTLDGANVEIREEVGADNFFLFGAKAREIVGLRKERARGKFVPDPRFEEVKKFVRSGVFGSYNYDELIGSLEGNEGFGRADYFLVGQDFPSYLECQEEVDKAYRDQKKWTRMSILNTAGSSKFSSDRTIHEYAREIWNIEPVKLE

SEQ ID NO: 18189 - protein, 508 aa, Zea mays
MGAMMASITSELLFFLPFILLALLALYTTTVAKCHGTHQWRRQKKKRPNLPPGARGWPLVGETFGYLRAHPATSVGRFMERHVARYGKIYRSSLFGERTVVSADAGLNRYILQNEGRLFECSYPRSIGGILGKWSMLVLVGDAHREMRAISLNFLSSVRLRAVLLPEVERHTLLVLRSWPPSDGTFSAQHEAKKFTFNLMAKNIMSMDPGEEETERLRLEYITFMKGVVSAPLNFPGTAYWKALKSRASILGVIERKMEDRLEKMSREKSSVEEDDLLGWALKQSNLSKEQILDLLLSLLFAGHETSSMALALAIFFLEGCPKAVQELREEHLLIARRQRLRGASKLSWEDYKEMVFTQCVINETLRLGNVVRFLHRKVIRDVHYNGYDIPRGWKILPVLAAVHLDSSLYEDPSRFNPWRWKLQSNNAPSSFMPYGGGPRLCAGSELAKLEMAIFLHHLVLNFRWELAEPDQAFVYPFVDFPKGLPIRVQRVADDQGHRSVLTESTRG

SEQ ID NO: 18190 - protein, 377 aa, Mimosa pudica
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTSAEREIVRDMKEKLAYVALDYEQELETAKTSSSVEKNYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 18191 - protein, 246 aa, Triticum aestivum
MGAEAEQQQQLPPPSPQAGKADPPAVVGLQVSALIDHVARVDWSLLDRVPGDRGGSQQVSFEELDHILNEVNALILPSHDDPSPVRTMAGGSVANTVRGLSAGFGISTGIIGARGDDDQGILFVNNMSFSGVDLTRLRAKKGHTAQCACLVDASGNRTMRPCLSSAVKLQANEFTKEDFQGSKWLVVRYAQQNLAQIIEAIRVAKQEGLSVSLDLASFEMVRDYKSQLIALLETGNIDLCFANEYE

SEQ ID NO: 18192 - protein, 397 aa, Francisella tularensis subsp. holarctica
MASLNKKIQNVSTSPTNAMAALAKQIKDQGNDVISLAIGEPGFSTPDIIKAAGIEAINKDITKYTNVDGLKELREAIVARYKREYGIEFAADQVCVTSGAKHSLHNIFNCILEAGDEAIFFAPYWVSYPDMIALTGAKPVVVETKFENNFEIDVTDLEKHITAKTKAVIINSPNNPTGLIYSKKCIEDLANLLRKYPNIWIIGDDIYDQLYFKDRVTLITEVAPDLADRYVIASGVSKNFAMTGWRVGFTIAPKLLNDALKKFQSQSATCACSISQYAAITAMNMPAQDLQYFVESYKQKAQFITKYLEAMPYIDVKSAEGTFYLFPDLRKLLEHTNFSTDVELCNALLREEYVAMMPGVAFGLSGFARISCANEMPELEEAMTRVARFINKHVSTK

SEQ ID NO: 18193 - protein, 265 aa, Oceanobacter sp. RED65
MSKTTINTLHKIKQNQEKFSVVTAYDATFAGLASTSGIDVLLVGDSLGMVLQGKDSTVPVTMEEMCYHTQAVKNGNQGSLLMVDMPFMSYATPEQAMANAAELMQAGAEILKLEGGAWLVDTVEMLSERGVPVCAHLGLTPQYVHKFGGYKVQGKEQAAAEQMLADAKAMEAAGADLILLECVPSELAKTLTESINIPVIGIGAGSDTTGQVLVCYDMLGMNSGHVPKFVKNFLIDGRNIQQAFAAFDQEVKSGDFPGPEHGFKA

SEQ ID NO: 18194 - protein, 344 aa, Oryza coarctata
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKDNVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAKLEHNH

SEQ ID NO: 18195 - protein, 305 aa, Panicum maximum
MAFVMGARIAGFMLLLVLMVEAGVYAGTGSQHVDANEWSMVPGVLGEMIQRGMTSRLEDYKYQPPAHDRSCTLLYEATARCSSTSMLFFNEHDVLEGKTFPMYFPPSVTAKLGFLQRRVVQEIPFTSARLADILALFHIPPGSSEAADVATTLGLCDAAAHGDVVRCVTSPDDMVGRAAAVLGTSNMQVLAPSIPTGGMSLQPYTVRAVKPVDGSDFVGCHPELYPYSVYRCHTSVQTGTYVMEMQSSYGNGGALKLVAVCHRNTTSWDPEHVSFKVLASKPGGLPICHFVPYGHVIFGKRAPDA

SEQ ID NO: 18196 - protein, 214 aa, Luffa aegyptiaca
MAMAKREIVLVFVLTILFPMVKSQTFDSFWMVQHWPPAVCSFQQGRCVGQGLRSFTIHGVWPQKGGTSVINCPGPTFDFTKISHLESTLNVDWPNVITGNNKWFWGHEWNKHGICSVSKFDQQAYFQMAINMRNSIDLLSALRVGGVVPNGRSKARQRVQSAIRAQLGKEPVLRCRGTGRQSRLLEIVMCFDDDGVTLINCNPANSNCPNSFIF

SEQ ID NO: 18197 - protein, 522 aa, Oryza sativa (japonica cultivar-group)
MDKAMAFIPPRDLVVVLPFLALLLPLYIYLRYSRSAKANPSLPTEWPLVGMLPSLVANIHNLFDYATALLAASGNSFEARGPPMSSLRFFVTCDPDNVRHIFINNFANYPKGEEFASFFDVMGDSFFNADGESWRRQRARVQHVMSNPRLLASMAACCRGKVEKGLLPILDRMASAGAPFDLQRLLTRFAFDVTAMAVFGVDTCRLSIDMPPLDVANAMDAVMEVGFFRHTVPVSCWKLMRSLRIGPERKLTAAQRLLRRFVAEMIEKRRVAGGACKATDDEQGGVPPPADIVSSYINDPEYVDEDGNPREFMYATFINYMVAGRDTVGTALSWLFFNLTEHPRVVARIREELEPIASSKAGGGGMVVFDPEETKPLVYLQAALFESMRLYPPGPIERKATLAEDVLPSGHTVRAGDNILIPVYSMGRMASVWGKDSGEYRPERWVTEDGKLRHVPAHRFMPFNAGPRLCLGKDISVLQMKSVAAAVAWNFDLEVVAGHAVEPKVSIVMQIKNGLMVKVKKR

SEQ ID NO: 18198 - protein, 1764 aa, Magnaporthe grisea 70-15
MSSADKSSRQSSGGKSFFSRSKNKDRRNTSDDSNGRYLVGGDQDHASIISSRASSRHQRDSSVVSIDAPDSPNPGLNHMAGVITSIPYDNVPPDRRSPIPTEYLPKGDQAPVRRDPLPHQLNKAGSDFHQYPNFDTNSMDYNRISHSSQGAPRVVPGSNVTMASTGRQTQFQQWGPARDSGFGAGSHNSRYNSYATSAGRSSADQSSIYSALPSASSQSSYPVQSPRESHRLTKFPGSPSAVVQGSSEDFRLAKPDDDHIIEQMFLALMQKRGWHNLPDQARRQMVAYPAAKKWTLIYQDRLSEWQGEQRRRQTARPGQIQSFDVTTFSDEEGTPEWYVRKVMDNSLDTKLLGSLEVSLRTQQINWVKRFIECQGQVALTNVLMKINRKTASGPAGVTSDAKNDKNLDREYEIAKCLKALMNNKFGADDALAHQNVIVALATSLMSPRLHTRKLVSEVLTFLCHWADGEGHLKVIQALDYVKNQTGENGRFDAWMRLVEVTVDGRGKMGSLVGASDEMRSGGVGAENLLMEYAVATLILINMIIDSPEKDLQLRLHIRAQFNACGIKRILTKMEAFQYDLIDKQIERFRSNEAIDYEDMLDRENSSIKDNVEGEIKDLNDPVQIVDAIQSRLQGSRTHDYFVSALQHLLLIRENDGEERLRMFQLVDSMLSYVAMDRRLPDMDLKQSLNFTVQSLLDKLHTDSEARQAHDDALEARQIADAAMAERDEMKAQLELGADGLVAKLQRQLDEQARFIEAQKRQADGLKSELENLQTIRAKEAQRYELETRELYLMLRDAQDVAASQAVKGVKAVGNDEAARVQQQGILDRDRLMERLQMQIERQKTQFKLEGRVWGEAAGPSDRLRALREEMDGIGGDPEMEEQGGTVSGTAPRDLTNSMLGSVKRQTRVSRKPVKTSANLVPGAVTEEDIPEEDDEDVIYEKPRVVEIRRPTVDPKQQAGLLNEIAGKVKRYDGSDSEDAEDGVTTGPTHPSVESQTPLTPKDQEPPKTPKIEVTPAMDGVVGAAAPPPPPPPPPPPMPGQLPGAPPPPPPAPPLPGTAGTPAPPPPPPPPPLPGKGMPAPPPPPPPPPPPLPGMKGMPPPPPPPMPGSMSGHFLAKQPGFVAPTIGLPVVRPKKKLKALHWDKVDAPSTTHWAAHAPSAEEREEKYLELSRKGILDEVEKLFMAKETKMIGKGQSHKDDKKQIISADLRKAYEIAFAKFSSYSVEKIVQIIIHCDKEVLDNNVVMDFLQREDLCNIPENIKKQMAPYSKDWTAPKAMEEAREQDPAELTRQDQIFLMTAFDLNHYWNSRMRALALTRSFEPDYEEISEKIRQVVSVSESLRDSVSLMNVLGLILDIGNYMNDANKQARGFKLSSLARLGMVKDEKNESTLADLVERIVRQQYPEWESFATDIGGVLTAQKINIEQLQTDARKYVDNIKNVQRALDSGKLSDPTKFHPQDRVSQVVQRCMKDARRKADQMSLYLEEMVRTYNDIMTFYGEDPADENARRDFFAKLALFVNDWKKSREKNVQIEETRRKNEASMKRKQAQLKPLGIGGPSDVGPVSPSSAGAMDSLLEKLRAAAPQARDQRDRRRRARLKDRHQVRIASGQKIPDLNEIPEVEAGLQTGRSTTSSRATDDDGNLLSPDFASLGSPKSADENDVAQRAAMMLQGMRDGEGPEDAEKREMMRRARRQTAEEERRARRRRREQAGSTISSHGGDLEERAEEGGGDGAEDANGDLLTPKPEQEPGSESEPKSEATVAAAT

SEQ ID NO: 18199 - protein, 417 aa, Ralstonia solanacearum
MADIKNYTLNFGPQHPAAHGVLRLVLELDGEVIQRADPHIGLLHRATEKLAEQKTWIQNVPYMDRLDYVSMMVNEHAYVMAIERLLGIDVPLRAQYIRVMFDEITRIMNHLMWIGAHALDVGAMAVFLYAFREREDLFDMYEAVSGARMHAAYYRPGGVYRDLPDSMPQYKASKVRNEKALAAMNETRSGSLLDFIEAFTDRFPTYVDEYETLLTDNRIWKQRLVGIGVVTPERALQKGMTGPMLRGSGIAWDVRKKQPYEVYDRVDFDIPVGVNGDCYDRYLVRVEEMRQSNRIVRQCVEWLRKNPGPVITDNHKVAPPSRVEMKTNMEELIHHFKLFTEGMHVPEGEAYAAVEHPKGEFGIYVISDGANKPYRLKIRAPGFAHLAALDEMAKGHMIADAVTIIGTQDIVFGEIDR

SEQ ID NO: 18200 - protein, 214 aa, Luffa aegyptiaca
MATKVLLLATIVLLLTILFLGAESQTFDHFFFVQQWPPTTCQQQQKPCFQPPPATFKIHGLWPQKGPNSVVYCNKNFDRTQISSLENQLDVVWPDVVTGNNTGFWEHEWNKHGSCSESQFNQTLYFQTAINMMNKVNLLKALGKGGITSDERTKSSQTMQKVLLAQFGNQPFLRCKKVGQQFWLLEIVMCFKDDGVTMINCQPSKVSCPPNFIF

SEQ ID NO: 18201 - protein, 979 aa, Ustilago maydis 521
MITFIPLSVPYATAASAAAEVEGSEKSVRTKLASDSASSEEQEHPRALAYLLQMDDVRVLIDCGSTEDFLFHGTSSQSDDSADAEAESQPQPESSSMAQQRQASDLDINHLKAAPLDTLLRQLASTIDLVLLSHSSLDHLGLYAYAHANLGLRCQVYATMPVQSMGKLTVLEAIQTWRSEVDIEKECTSASTRRCLATPDQVEDAFEEIKTVRYMQPTHLEGKCASLTLTAYNAGHSLGGAVWKIRSPTSGTVVIALDWNHNRERHLDGTILLSSSAAAPGAPGSGASASDAVRRPDLLITEIERGLVVNTRRKDRDAALIDLVHTTIQAGNSLLFPVDASARLLELMVLLDQHWAYAYPHARFPLCLISRTGKEVIERSRTYMEWMTREWATKANETIEADKDTLPAKMQQRNARGGGLRPAAASSPLDFKYVKVFPTLQAMDEAIPQDQAKVVLAVPPSMTHGPSRKLLARFAQNPNDVVVLISRGEPGSLCRELWDAWNTNQSKGFSWSQGKLGQAVVASNTSLRFELKSKVPLEGDELRAHREAEQAERERLAQQRALLARSRRRLEADEDDSSDSDSEGGEEGENETVYDVAGGADEPGGAMIRKRPYGVAFDEATNPGGALSGGAGASGDTNQLSFDIYLKGNASRATSFFGSKAGQEGPFGLGVRYRLFPAIERKRRVDGFGEVIDVTRWLSRRRALEAAESAAADPLSESATLTAEAKRKQLAAQEEARAAAVPCKFITQLVSVQLNCKVAFIEMCGLNDGRALKTLIPQLHPRRLIMVNGDRETNADMLDVLDAIKSLTRDISAPRWLESVQIGQVTNSYTVQLGEGLLSRLELSRFEEFEVAHVRALVRRGMGDAEMGGVAMLETEEDVAAATAAAAEQAEREDTAKQNVLDELALSGIMRSVASQTIRASRFGASSSVDCAHSPVQGTLFIGDLKLSTLKALLSSSPYRLPADFAGEACPKGAKAGLS

SEQ ID NO: 18202 - protein, 434 aa, Bacillus cereus ATCC 14579
MVYLNDKLSETKVFKDPVHKYVHVRDRVIWDLIGTKEFQRLRRIKQLGTTFFTFHGAEHSRFTHSLGVYEIIRRMIDDVFDGRPNWNAEDRLLCLCAALLHDVGHGPFSHSFEKVFSLDHEKFTQKIIVGNTEINDVLSRVDKEFPQKVADVIAKTSTNKLAISMISSQIDADRMDYLLRDAYFTGVKYGNFDMERILRVMRPYGDQVVIKNSGMHAVEHYIMSRYQMYWQVYFHPVTRSAEVILTKILHRAKSLHEKYYTFKNHPVHFYSLFEEEVTVEDYLKLDENVMYYYFQVWQEEEDPILSDLCRRFMNRNLFKYVEFTDKHGLDNWMELSSLFKKIGLDPEYYLVVDSTSDLPYDFYRAGEEEERLPILLLMPNGELRELSRESDIVEAITGKKRTDQKLFYPHDLIYEDGRKGKYKERIIELLEGKK

SEQ ID NO: 18203 - protein, 357 aa, Rubrivivax gelatinosus PM1
MPTGGKSTLTQFLIEERRKHPAATGELNALITDVSLACKAISRKVAFGGLAGVLGSAGSGNVQGEEQKTLDVLSNTMFLRATEWGGHVAGMVSEELEAPYTLPPQYARGKYLLMFDPLDGSSNIDVNVTVGSIFAIHRAPQPRQDPQPQDYLQPGTTMVCGGYAIYGPSTMLVLTLGDGTHAFTLDPQLGEWVLSHPNLRIPEKTREFAINASNSRFWEPAVKRYVDECLAGSTGPRGTDFNMRWIASLVAETHRILMRGGVFLYPRDSKDPNKAGRLRLLYEANPISFLIEQAGGMASTGRKRLLEVQPEDIHQRIGFVFGSTEEVARIEAYHRDEPPTPYNSPLFGKRGLFAEAG

SEQ ID NO: 18204 - protein, 443 aa, Leptospira interrogans serovar Copenhageni str. Fiocruz L1-130
MNQNKPTSKLISDFWKGKTSEELFERAKKVSPGGVHSPVRSFRSVGGTPVFFASAKGATLTDISGKEYIDYCLSFGPLILGHRDPEIEEVVRETTEIAWSFGAAEPYSLELAELISSRVPWAEKVRFVNSGTEAVMSALRVARAATGREKILKFDGCYHGHLDSLLVKAGSGLAGESSSDSAGISATSIANTLVLPLDDEASVERVFETEGKNIAALIIEPLPANYGLLIQRKEFLLKIVETARKYGTLVVFDEVISGFRVGFQGMSGLLGIWPDLVTYGKIIGGGFPVGCYAGKKDLLDLVAPSGPVYQAGTLSANPFGMRAGLATLKKAQRDSIYSVLDDRTKIFTDTMTKLLNKKSNQEWEAVIHSSLFWFRKKTQQPIRRIDLIPEGHKESFAKVFHTFLKNGIYLAPSGYEVGFLSWAHDDEIIAKTLEIADKALKTF

SEQ ID NO: 18205 - protein, 899 aa, Yarrowia lipolytica CLIB122
MAAIREYVGSLLNNATGGSANNSNSGINSAPDSAGTSPKKHSLALPHTPPTGTSRAASHSSAFNSASDEADDNVQFRDIHPAALVRTETEDVDRQLNHFHFEDRGASSEPEQIPLRGRQGRKDDPYGSTFFSAKETFLDGRDRDIKLVIPETRDSRELSRPRRSPVSATASSHSGGGFFSRILQKRKNSGRQSIEAEEQEDDEQDQDGEDKRAEGWCADVMGYAPNYSMFSDLKYVKVRAHHRPSHQKKRNFDRLFLAQELRTHDPSDPLATDNSRLASQTAQKVISSSPIGAIWAMKFSLDGRYLAAAGQDRVLRVWKVCTRPQNSPYEDYFGFKGTKMYAPVFEESPEREFRGHEGDILDLSWSKNNFLISSSMDKTVRLWHPDRQEEIASFPHNDFVTCVEFHPKDDRFFVSGSMDRQLRLWSILDNQVAFARQVPDIVTAVAFTPNGNTVIAGCLRGQLYFYQTHQLVLQTQLQVRISTKVKHAYKSKITGIQVVTEPKKSRTHNNIYNPMHAAVAAEDDYKMLITTNDSRIRLYNYRTKALIAKYRGLDNDHSQIKASFSDDYRFIISGSEGERTYIWDTIRSDSGTGLNHVSSKTIKAYEYFHSHQSTVTVALFAPLQTRQLLDLAHDPIYSIVNPPKVVLGQNDMTPEKALYPHHDGHIIVAADYSGKIKVFRQDSAYTKRKLAEDSASFIQSRRSLNSIGGASGRSSPRGRSSRSSSASAWNRFSRGVRSPAVSPGTSVHRKSFGASTSTGPAPFGVIANGLSSANHTIMDPSTFPRARKSSTSGLSQISRRTSESLFSPEKSVPEIHVNDEDGREIEPTGSIRSNSVLMTDSDQELDEDTDQEEQDELTEQASLVCEKCGSQNFKVRVIEGMVILCCSACRTPISEAAST

SEQ ID NO: 18206 - protein, 469 aa, Idiomarina loihiensis L2TR
MSANKIFDTIKEHDVKFVDLRFTDTKGKEQHVTIPVSQIDEDFFEEGKMFDGSSISGWKGINESDMVLMPDNESAVIDPFTDEVTLNVRCDILEPETMQGYSRDPRSIAKRAEDFLRSSGIADDAYFGPEPEFFLFNDVRFHTDMSGSFYKIDAEEAKWNSGREYSEGNLAHRPGVKGGYFPVPPVDSAHDIRGTMSLVMEDMGMVVEAHHHEVATAGQNEVATRFNTLTKKADELQVYKYVVHNVAHSYGMTATFMPKPLVGDNGSGMHVHMSLNKGGENLFAGDQYAGLSETALFYIGGIIKHARAINAFANASTNSYKRLVPGFEAPVMLAYSARNRSASIRIPLVSSAKGRRIEVRFPDPSANPYLAFTALLMAGLDGIRNKIHPGDAMDKDLYNLPPEEAKDIPTVCHSLEMALDALDKDRDFLKQGGVMDDDMIDAYIDLKYNEVETLKKTTHPVEFDMYYSV

SEQ ID NO: 18207 - protein, 331 aa, Musa acuminata
KIKIGINGFGRIGRLVARVALQSDDVELVAVNDPFITTDYMTYMFKYDTVHGSWKHHEIKVKDSKTLLFGEKEVTVFGIRNPEEIPWGESGAEYVVESTGVFTDKDKAAAHLKGGAKKVIISAPSKDAPMFVIGVNENEYTSDINIVSNASCTTNCLAPLAKVIHDRFGIVEGLMTTVHSITATQKTVDGPSSKDWRGGRAASFNIIPSSTGAAKAVGKVLPSLNGKLTGMSFRVPTVDVSVVDLTVRLEKAATYDEIKAAIKEESEGKLKGILGYVEEDLVSTDFVGDSRSSIFDAKAGIALNPNFAKLVSWYDNEWGYSSRVIDLIRHM

SEQ ID NO: 18208 - protein, 362 aa, Zea mays
MTKSGALQLARSTGGSLSKDQVKSAVDQYVKYHDLHGGEQESRKSNYADLANKYYDLVTGFYEYGWGDSFHFAGGPILPCLYFRYPGETSREAIKRHQHFMALQLGLKKGMKVLDVGCGIGGPLIEIARFSSTSITGLTNNDYHISRGKELIFSAGLSEQCCSLKGDFMNMPIADNTFDAAYAIQATCYAPEAQGVYSEVYRVLKPGQYFALDEWCLTDRFDPNNAKHLTAKAEIELGDGLPDIRTTRQCVQAMKDAGFEVIFAKDLAQDFPCPWYQTMDPNYFSWANFQCTRPGRIITRAIVNTLEFLRIAPAGSVGAYNVLTSASDGLLKGGREGIFTASFFVLGRKPLKESEIVNGGNL

SEQ ID NO: 18209 - protein, 489 aa, Bordetella bronchiseptica RB50
MTQLTQPLSRAELLRDACYIDGKWVGAGNGPSIPVDNPSTGKTIISVPKLGRKEAEQAIDAAEAALPAWSARTGKERAAILLKWAQLMMENQQDLAVIMTSEQGKPVAEAAGEIAYAASFLEWFAEEAKRIDGDILQSPKGGQRLMVLKQPIGVTAAITPWNFPAAMITRKVGPALAAGCTMVVKPAQQTPLTALALAVLAEQAGVPAGVFQVVTGSSREIGAALCESEVVRKLSFTGSTEVGRTLMEQCAPTIKKLSLELGGNAPFIVFDDADLDRAIDGILASKYRNAGQTCVCANRIYVQAGVYEEVAKRLVEKVNAMKVGDGFEQGVTQGPLIDTAAVAKVQEHIADATAHGAKVIAGGQPHALGGSFFQPTVVRDVTQSMRFAVEETFGPVAPLFKFESEDEVIGMANNTIFGLAAYFYTRDYARIWRVSEALEYGIVGINTGIISNEVGPFGGVKQSGLGREGSKYGIEDYLELKYLCVDLGA

SEQ ID NO: 18210 - protein, 488 aa, Xylella fastidiosa Ann-1
MSERQRRTRILATLGPATDPPGVLDALFKAGVNVVRLNFSHGDVSDQARRAAEVRAAAAHVGVEIGILADLPGPKIRIGRFIGGKVRLVAGARFDLLADSNASLGDATQVGVSYLGLPQDVVAGDVLLLDDGLMQLQVVQVQGARIVTTVLNDGVLSDRKGLNKQGGGLSLGALTDRDRELIGIVARMGIDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPMPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGCVSGLWEL

SEQ ID NO: 18211 - protein, 295 aa, Nostoc sp. PCC 7119
DVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLEGMEEGIDAALSAAAAKEGVTWSDYQKDLKKAGRWHVETY

SEQ ID NO: 18212 - protein, 100 aa, Glycine max
  misc_feature (29)..(29): Xaa can be any naturally occurring amino acid
  misc_feature (56)..(56): Xaa can be any naturally occurring amino acid
  unsure (1)..(100): unsure at all Xaa locations
LKGYHSWKFNGHLRKTGIREDTSFHYHAXDLMIDVHVPQDSSNRPVLNTSWLSSPXRSLSSLCFAISPHHLIEASFRGLDQFHVLIVAHPQWLSVHTLFH

SEQ ID NO: 18213 - protein, 314 aa, Gluconobacter oxydans 621H
MSLCFITQQIHPDAETYLNNAGIRTRYATAPTMEAVIREVGDADAVITRDLGFSAEALDAAPNLKIISCHGSGTNRIAKAAAAARGVLVTNAPNTNSRSVAEMTIGLLLAVVRRLCEADLAVREGNWEFRYTGKGMELHTRTLGLVGFGAIARHVAQIAGQGLGMRVMAWSPSVPADVFEGAGVMRANSLDDLLVASDVLSLHRPAQGSGRPTIDASALFRLKQGAILINTSRGGEVDGPALAEALEAGHLGGAGLDVMSPEPPLPDDPLLRAPNVVLTPHIGATTEQALRRMAMMCASQVQDALAGRVPPHCL

SEQ ID NO: 18214 - protein, 128 aa, Brassica napus
  misc_feature (2)..(2): Xaa can be any naturally occurring amino acid
  misc_feature (10)..(11): Xaa can be any naturally occurring amino acid
  misc_feature (22)..(22): Xaa can be any naturally occurring amino acid
  misc_feature (26)..(26): Xaa can be any naturally occurring amino acid
  misc_feature (35)..(35): Xaa can be any naturally occurring amino acid
  misc_feature (53)..(53): Xaa can be any naturally occurring amino acid
  misc_feature (65)..(65): Xaa can be any naturally occurring amino acid
  misc_feature (71)..(71): Xaa can be any naturally occurring amino acid
  misc_feature (83)..(84): Xaa can be any naturally occurring amino acid
  misc_feature (86)..(86): Xaa can be any naturally occurring amino acid
  misc_feature (93)..(94): Xaa can be any naturally occurring amino acid
  misc_feature (99)..(99): Xaa can be any naturally occurring amino acid
  misc_feature (101)..(102): Xaa can be any naturally occurring amino acid
  misc_feature (105)..(107): Xaa can be any naturally occurring amino acid
  misc_feature (111)..(111): Xaa can be any naturally occurring amino acid
  unsure (1)..(128): unsure at all Xaa locations
MXSSMLSSAXXVTSPDQATMVXPFTXLKSSAAFPXTRKANNDITSIASNGGKXSCMKVRTPVGKXKFETLXLTFPDLTEVELXXEXDYPSPHXXIPCVXFXXEHXXXHRDXREAPPYAHVEFPTPSRF

SEQ ID NO: 18215 - protein, 277 aa, uncultured delta proteobacterium
MTGEKITVPDIMAAKGNRKLTMLTAYDYPTALLADKGGIDMILVGDSLAMVVLGMEDTLSIGMDEMIHHTRAVKRGTSRGLVIGDMPFMSYQTSIKQALINAGRFLKEGRAQAVKLEGGARVCPQIKAMVESGIPVQGHIGLTPQSAAQFGGFKVQGKNAEAAKTLIEDAKLLEQAGCFSIVLEAIPAPIAAMITDAVSIPTIGIGAGSACDGQVLVMHDMIGLFDRFVPKFVKQYAKVSDIILQAVKAYKNDVETGQFPTMDQSFTINTEELEKIK

SEQ ID NO: 18216 - protein, 403 aa, Francisella tularensis subsp. holarctica
MFEQIKNNVENAIEALKQGKPVVVLDDYDRENEGDLILPGQKATEENITFMLEHTSGIICLAMDSKKARELNLTPMVAADQNNSTFTTPFTVTIEAKEGVTTGVSAKDRAHTIQVASKADAKAEELARPGHIFPLIANDKGVLGRNGHTEATVDLMKLSGFNSAGVLCELMNKDGTMMKAAELEAFAKKHDLPLLTIAELYQYRLATEIFVTKMASSTIPFKKIGELEMSVYKDNFSGDEVVVLSKPYSGNNPLVRMHSSCITGDIFGSLRCDCQDQLHKGIEMISEEGGFFIYLDQEGRGIGLTNKLKAYNLQMNENMDTLEANLALGLPADARKYDLAIQVLKYNNVNRCRLISNNPEKLAALRNVDIETQPVYCEAFVNSHNRNYLITKKIKAKHTIKGI

SEQ ID NO: 18217 - protein, 248 aa, Ralstonia solanacearum
MSARPKLVVGNWKLHGSLNGNAELLEKIKAAGQTRAALAVCAPFPYLAQCQSVLAGSSVAWGAQDVSAETRGAFTGEVAASMLSEFGCGYAIVGHSERRTYHGETDAQVAIKALRALEHGITPIVCVGETLAQREAGETELVVARQLEAVLESLSVEQLGHIVVAYEPVWAIGTGKTATSEQAQAVHAFLRGRVAACDAGVAQRMPILYGGSVKPDNAAELFTMADIDGGLIGGASLKAEDFLAIGRA

SEQ ID NO: 18218 - protein, 383 aa, Listeria monocytogenes str. 1/2a F6854
MMNHSKIAKKHQQMPVNILADIGTLAKTMPDILDLSIGDPDLITDESIINAAFEDVRAGHTKYTESGGDVELIDAIRGYFSRNYDLSFERSQIRATVGALHGMYLTLQTILDDGDEVIIHEPYFSPYKDQVLNSGGTPIIIPTYEKDDFAINVDILEAAITDKTKALILNSPNNPTGAVFSPETFEKIANLAKKYDFFILSDEVYDGFSFYEDFVPMAKFAPDHTITFGSMSKNFAMTGWRLGYMIAPTYLNEAAKIINEGITYSAPTPSQRAAIYALNHSETLIPLVAETFQKRLEYIAKRVEKIPYLSLHPLKGSIYAFINISKTNMDSVSFTEYVLKETQVLVIPGLAFGESGDNYVRLAATQDISVLEEAFNRLAKLTF

SEQ ID NO: 18219 - protein, 485 aa, Mesorhizobium sp. BNC1
MLKKTSHFLREANFIAGEWVNADSGATIEVINPATRQTIGTVPKCGRAETRRAIEAAQEAFQSWKKTSANDRAKLLRKLHDAIMDNQDALAELLVMEQGKPLAEAKGEVGTSAAYILWFAEEGRRIYGDIVPAPWTDRRILVTKEPVGVIGAITPWNFPSSMLARKLGPALAAGCTTVAKPASQTPYSGLAWGVLAEEAGFPKGVVNIVTGSASEIGDELTENPLVRKITFTGSTEIGKLLMEKAAGTVKKVSMELGGNAPFLVFDDADLDRAVKGAMIAKYRNAGQTCVCTNRFFVQDGIYDRFLEKFVEASRKLKVGSGLDEGVEQGPLIDGGAVEKVEELIADAVSKGGKVVTGGKRHALGGSYFEPTVIAEATPQMRFMEEEIFGPVAPVFRFKDEADGIRMANDTSFGLACYFYTSDLGRAFRVMEGLKYGLVGVNEGLITTVEAPFGGLKESGLGKEGGRQGIEDYLDTKYVCIGGLGL

SEQ ID NO: 18220 - protein, 791 aa, Oryza sativa
MAAAAAAAAPRHHHHHVVVGSSRSAPVSVSVCVRRWCGGASSSALLRVGMIGGASASSAEGRGRRRWWRRGRRALRVRAAAGMDIASAVEVINDLGFDTLTFLGVTVLVVPAFRVVKASPILGFFCAGVVLNQFGLIRNLTDVKLLSEWGILFLLFEMGLELSLSRLKALARYAFGMGLPQVLLSTLAFTAFELPPNGAIGTKILQFLFDSRPDLVNIRSVDEAIVIGAALSLSSSAFVLQLLAEKGELPTRFGSATLGILLLQDIAVVPLLVILPVLESQNVVEQSVWPMLLAESLKALGGLGLLSLGGKYLIRRIFEFVAESRSSEAFVALCLLTVSGTSLLTQWLGFSDTLGAFLAGAILAETNFRTQIEADIRPFRGLLLGLFFVTTGTSIDMELLIREWPNVLSLLGGLIAIKTLIITAIGPRVGLTLQESVRIGLLLSQGGEFGFVVFSLANRLGVLPLELNKLLIIVVVLSMALTPLLNEIGRRAAGIIDEKSETKEKPAEMVNYDATEPIVILGFGEMGKVLAKFLSAPLSFGLDKDAEGWPYVAFDLNPAVVKSARKSGFPVLYGDGSRPLVLQSAGVSSPKAVMVMYTGKEKTIEAVNRLRQAFPGVPMYARAQDMSHLLDLKKAGATEVVLENAETSLQLGSMLLRGLGVMSDDVSFFSKLVRDSMELQAQEALNNIENREIDIMKPLEIRISDLVERNGNGSRMIAQEDSLRLSSRPNIPLIEATLEDRIPETTGENDQTGYDFNNIDSEDGVKYCLLEASDDESEASNSSKEMIDQSV

SEQ ID NO: 18221 - protein, 537 aa, Alternaria solani
MQTHLLILAAVVLLIIHIVNNFLIKPLQTLLKSRRLGCGPVPFEPTRWPLDIDTIRRSLKADKEQRTPDFVAGRFETMGRYTWGLSLLGTSNLITAEPRNVQALLATQFDDFIMGTARRTNLKTALGRSIFAVDGKAWHRARETMRPIFSRENVSRLELLEEHVQTMLQIIETKDEGLTTDANDRAWSAPVSLAVLLPRLTMDSATELFLGQSTHSLKKALARQQQKSGNEEHDADSFDHAFERMLAILGTRMRLRSLYWLYGNKELQKCINALHAFVDSAIDAADQARKSGSSQLRYDFLETLRTRCSDRAEVREQVLGLLAAGRDTTASLTAWVFYCLVRNPRVYKKLRDTVLAEFGPYSTNPGQKITFEKLKGCTYLQHVLNETLRLHSVVPFNSRCAARDTTLPVGGGPDGSMPVFVPKGTEVNFSTHVLHRRKDLWGEDADEFVPERWEKKRPGMTWQYVPFNGGPRICIGQQFALTEAGYVLVRMVQRYDVIEGLDIDVERDWHNFTVVCSPGSPVARDAAVMCRLRVAVE

SEQ ID NO: 18222 - protein, 358 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTARTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 18223 - protein, 469 aa, Bacillus subtilis
MNQSQSGLKKELKTRHMTMISIAGVIGAGLFVGSGSVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 18224 - protein, 143 aa, Shewanella sp. ANA-3
MAIERTFSIIKPDAVAKNHIGAIYNRFETAGLKIVAAKMLHLTKEQAEGFYAEHSERGFFGALVAFMTSGPIMVQVLEGENAVLAHREILGATNPAQAAPGTIRADFAESIDENAAHGSDALESAAREIAYFFSAEELCPRTR

SEQ ID NO: 18225 - protein, 540 aa, Gibberella zeae PH-1
MPQKSENQNKSVMATTAQDHLEFGGKISWLASLDTAFRPERNYRRSSIICTIGPKTNSVEAINKLRDSGLNVVRMNFSHGSYEYHKSVIDHARESEATHAGRNVAIALDTKGPEIRTGNTPGDEDIPISVGHEMNITTDDAYATASDDKNMYVDYKNITNVIEPGRIIYVDDGVLAFDVLKIVDEKTILVKARNNGAICSKKGVNLPNTDVDLPALSEKDKADLKFGVENNVDMVFASFIRRAQDIYDIRDVLGEQGKRIQIIAKIENRQGLNNFREILEATDGVMVARGDLGIEIPAAEVFAAQKKLIAMCNLAGKPVICATQMLESMIKNPRPTRAEISDVGNAITDGADCVMLSGETAKGSYPSEAVKEMHEACLKAENTIPYVSHFEEMCTLVKRPVSTVESCAMAAVRASLDLGAGGIIVLSTSGESARMLSKYRPVCPIFMVTRSPTTSRFAHLYRGVYPFLFPEQKPDFAQVNWQEDVDRRIKWAVNNALELNVLTPGDTVVVVQGWKGGMGNTNTLRIVKADPEHLGIGQLQ

SEQ ID NO: 18226 - protein, 516 aa, Oryza sativa (japonica cultivar-group)
MDMLLCFVEIFSILCCCIIYYYHLQTKKASASEPTEWPVLGHLFGMFANIHRFHDWATDILAGGWHNFEARAGLTGIRFFITCDPSNVRHIFTSNFANYPKGDEYAEIFDVLGNGIFNADGESWRSQRAKAQMLMAGARFRAFAARSSRDKAEKSLLPLLAHAADTGARCDLHDLFLRLTFDVTCTLVFGVDTGCLSAGLPVIPFARAMDDVLETLFLRHIIPMSCWKLMYRLEVGTERKMAVARRTIDRFVAETIAKRRADMIRQGTSNSDDLLSSFISHDDDDTSNGNDVVDETDEFLRDTTVNLLLAGRDTTGAALSWFFYILSKNPRVEQKLLEELAPIAAQKGGDGGGMVIFDASELKNLVYLQAALSECLRLYPSVPFEHKAVAADDVLPSGHEMKAGDKVLVFSYSMGRMEGVWGKDCTEFLPERWITSEGKLRYEPSYKFFSFNAGPRTCLGKELAFVQLKTVAAAVMWNFAVEVVPGHAVEPKLSIILHMKNGLAVTVKRRATMASC

SEQ ID NO: 18227 - protein, 333 aa, Thiobacillus denitrificans ATCC 25259
MAIKVGINGFGRIGRMAFRAIAKDFPDIEVVAINDLLDPEYLAYMLKYDSVHGNFKGDIAVEGNNLIVNGKKIRLTAEREPANLKWNEVGAELVIECTGFFLTKETCQKHIDAGAKKVVQSAPSKDDTPMFVYGVNHEKYAGEAIVSAASCTTNCLAPIAKVLNDNWGIKRGLMSTVHAATATQKTVDGPSSKDWRGGRGILENIIPSSTGAAKAVGVVLPELKGKLTGMAFRVPTSDVSVVDLTVELEKPAKYADICAAMKKASQSGDISKTLGYTDEKVVSTDFRGNGFSSIFDAEAGIALDDTFVKVVSWYDNEYGYTCNMLRFVQHVAK

SEQ ID NO: 18228 - protein, 472 aa, Escherichia coli O157:H7 EDL933
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGV

SEQ ID NO: 18229 - protein, 359 aa, Agrobacterium rhizogenes
MFVRSDALSRIKPSATIVVSQKFRELKAEGRDVVRLNIGEPDFDTPDNIKTAAIDAINRGETKYTPVSGIPELRKAIASKFKRENGLEYSWEQTIVGTGGKQILFNAFMATLNPGDEVVIPAPYWVSYPEMVALCGGTPVFVSATQEHDFKLQPADLEKAITPKTKWFIFNSPSNPTGAAYTHAELKALTNVLMQHPHVWVLTDDMYEHLTYSDFKFVTPVEVEPSLYDRTLTMNGVSKAYAMTGWRRLCRRPAPAHQGHGHDPGAADLGCDVDRPVGGCRSAERHPGLHPGEQEDLRRPPRPRRLHAEPGQGHRLPGAGRRLLRLSVLRRPDRQDGAVGQGHRDGRGFRFRASGIGRR

SEQ ID NO: 18230 - protein, 434 aa, Bacillus cereus G9241
MVVKFTKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAEKHNIDITLNRLKGALTVYFTTNTIEDYDAAQDTDGEMFGKFFKLMLQEGVNLAPSKYEAWFLTTEHTKEDIEYTIEAVGRAFAALANNK

SEQ ID NO: 18231 - protein, 393 aa, Halobacterium sp. NRC-1
MRAIKDSVHDYIEADGVAAALLDTEPVQRLRHIKQLSTIRLVYPSANHTRFEHSLGVYHLADRALAHLDISGTRADTVRAAALLHDIGHGPYGHQTEGIIQRRLDRHHDDVAHLVSNGEPGAVLAAHGLDPDRVAALVAGHGKLGQLVAGELDVDRMDYLVRDAHHTGVPYGTIDHGRLLRALTFRDGDLVLAEGNVATAESVLVGRALMNATVYRHHVSRIAGAMLDRASARLLDTTDLDAETFARFTDADLLAVLRDCPATQDAARRIRNRDLYKRAVWTERDAVPDDVATADYRTVRDLESQVADAAGVPATAVVIDTPGAPSMPESSVRVTVNGDTRRLDEQSPLVDGMLASQRAQWRFGVYTPDDHVPAVAAAAERTLGLGPIDDPPA

SEQ ID NO: 18232 - protein, 467 aa, Xanthomonas campestris pv. campestris str. ATCC 33913
MSDVLPIILSGGSGTRLWPLSRESYPKQFLPLVGEHSMLQATWLRSAPVAAHAPIVVANEEHRFMAAEQLQQLGVKPSAILLEPKGRNTAPAIAVAALEATRNGGDPLLLVLPSDHVIRDEAAFQAAVTVAAAAAEQGKLVTFGIKPTAPETGYGYIKAGVGTGATAVERFVEKPDLATAQGYLASGEYYWNSGMFLFRASRYLEELRKFQPAIADACQKAWEGGKRDADFTRLDKDAFASSPSDSIDYAVMEKTADAVVVPLDAGWNDVGSWSSLLDVSEQDGQGNAHHGDVIQLDCKNTYAYGSRLIAMVGLENVVVVETDDAVLVGHRDRIQEVKEVVSQIKSAGRSEATWHRKVYRPWGAYDSIDMGQRFQVKRITVKPGATLSLQMHHHRAEHWIVVSGTAEVTRGEEVLLLTENQSTYIPLGVTHRLKNPGKLPLELIEVQSGSYLGEDDIVRFEDTYGRT

SEQ ID NO: 18233 - protein, 285 aa, Leccinum holopus
  misc_feature (69)..(69): Xaa can be any naturally occurring amino acid
  misc_feature (143)..(156): Xaa can be any naturally occurring amino acid
  misc_feature (263)..(263): Xaa can be any naturally occurring amino acid
  unsure (1)..(285): unsure at all Xaa locations
NIVAVNDPFIDLEYMVYMFKYDSVHGRFKGDVHSKDGKLYINGKAITVYAERDPANIKWGAVGAEYVVXSTGVFTTIEKAGAHLKGGAKKVIISAPSADAPMFVCGVNLDKYDPKYTVISNASCTTNCLAPLAKVINDKFGIXXXXXXXXXXXXXXQKTVDGPSAKDWRGGRAVNGNIIPSSTGAAKAVGKVIPSLNGKLTGLAFRVPTNDVSVVDLVVRLEKSASYDEIKAAVKAASESPDMKGIIEYTDEALVSTDFTGHXDSSIFDASGSIMLNPNFVKLIS

SEQ ID NO: 18234 - protein, 270 aa, Rickettsia conorii str. Malish 7
MNIGKFKLIVFDKLDSTNSEAMKMAQNAKVDSNYAVLAKSQTNGRGRSGKNWQSRSGNLHVSLLIKPDKELELLPQLSFVTALSVYDSITSLCHSHSALCHSRFRGNDIRNENNIIQLKWPNDVLINSRKIAGILLESVKVENNYYLIIGIGINITYHPDNIDQPTTSLISENLPPIEPQALLEILIENFEEYYQIWHNNGFPFIRKKWLEHAYKLYENISVKYQNDIVTGLFKDIDNTGRIILQLPSKKIISFSTAELFFSKNITKFKL

SEQ ID NO: 18235 - protein, 246 aa, Candidatus Pelagibacter ubique HTCC1002
MTNKYMYFVANWKMYGNLSSLNTLDKVIRFSKSKEIKGGRLIYCPPNTLISSFAKKFNNCQIGIGGQNCHESKDYGAHTGHVNSRMLKNIGAHFVIIGHSENRKQGESDKLINLKIKSALEAKLKVIFCIGETLSEKRKKKTRSILSKQIKIGLKNIKNKSNIFIAYEPVWAIGSGIIPKSYDLFKTIEFIKSKFRDKLPKVLYGGSVNPENITNLKKINNIDGFLIGGASQSAKKFIDIVKKTYS

SEQ ID NO: 18236 - protein, 521 aa, Methanosarcina acetivorans C2A
MWNSLHMTQARRPLMLMILDGWGYREASEGNAILAAETPNLNSLLNEFPWCFLECSGEAVGLPEGQMGNSEVGHLNIGAGRVVYQDLTRINLSVRNGDFFENPVLLDAISNVKLNDSSLHLMGLVSYGGVHSYMTHLYALIKLARDKGLKKVYIHAFLDGRDVPPKAALADIRELDAFCKENGSARIATVQGRYYAMDRDKRWERSKLAYDALTLGVAPYTTSDAETAVSDAYARGETDEFVKPTVVTGSDGKPEAVVQDNDSIIFFNFRPDRARQLTWAFENDDFDGFPREKRPKVHYVCMAQYDETLDLPIAFPPEELENVLGEVLSKQGLVQLRIAETEKYAHVTFFLNGGQEKCYDGEDRCLIPSPKVATYDLKPEMSAYEVTDEVIRRIQSGKYDVIVLNFANMDMVGHTGIFEAAVQAVEAVDTCVGRIIEALKKAGGVALITADHGNAEQMENQHTGEPHTAHTSNPVRCIYAGKGEVKALENGKLSDLAPTLLDLLGVPKPEEMKGKSLILNE

SEQ ID NO: 18237 - protein, 296 aa, Bacillus cereus ATCC 10987
MVIQWFPGHMAKARRQVTEKLKLIDVVIELVDARLPLSSRNPMIDEIITHKPRLVVLNKADMADDRLTKQWIAYFKEKGHMAISINAQAGQGMKEIAAACKVLVKEKFDKMVAKGIRPRAIRALIVGIPNVGKSTLINKLAKKNIAKTGDRPGVTTAQQWIKVGKEMELLDTPGILWPKFEDQLVGLRLATTGAIKDSILNLQDVAVYALRFMEKHYPDRLKERYNLNDIPEDIVELFDAIGKNRGCLMGGGMIDYDKTSELILRELRGGKLGKMTFETPEEFAEQTEDAEKVEEV

SEQ ID NO: 18238 - protein, 879 aa, Saccharomyces cerevisiae
PRLTRRLTGFLPQEIKSIDTMIPLLSRALWNKHQVKKFNKAEDFQDRFIDHVETTLARSLYNCDDMVAYEAASMSIRDNLVIDWNKTQQKFTTRDPKRVYYLSLEFLMGRALDNALINMKIEDPEDPAASKGKPREMIKGALDELGFKLEDVLDQEPDAGLGNGGLGRLAACFVDSMATEGIPAWGYGLRYEYGIFAQKIIDGYQVETPDYWLNSGNPWEIERNEVQIPVTFYGYVDRPEGGKTTLSASQWIGGERVLAVAYDFPVPGFKTSNVNNLRLWQARPTTEFDLNKFNNGDYKNSVAQQQRAESITAVLYPNDNFAQGKELRLKQQYFWCAASLHDILRRFKKSKRPWTEFPDQVAIQLNDTHPTLAIVELQRVLVDLEKLDWHEAWDIVTKTFAYTNHTVMQEALEKWPRRLFGHLLPRHLEIIYDINWFFLEDVAKKFPKDVDLLSRISIIEENSPERQIRMAFLAIVGSHKVNGVVELHSELIKTTIFKDFIKFYGPSKFVNVTNGITPRRWLKQANPSLAKLISETLNDPTEEYLLDMAKLTQLEKYVEDKEFLKKWNQVKLNNKIRLVDLIKKENDGVDIINREYLDDTLFDMQVKRIHEYKRQQLNVFGIIYRYLAMKNMLKNGASIEEVARKYPRKVSIFGGKSAPGYYMAKLIIKLINCVADIVNNDESIEHLLKVVFVADYNVSKAEIIIPASDLSEHISTAGTEASGTSNMKFVMNGGLIIGTVDGANVEITREIGEDNVFLFGNLSENVEELRYNHQYHPQDLPSSLDSVLSYIESGQFSPENPNEFKPLVDSIKYHGDYYLVSDDFESYLATHELVDQEFHNQRSEWLKKSVLSLANVGFFSSDRCIEEYSDTIWNVEPVT

SEQ ID NO: 18239 - protein, 337 aa, Aspergillus nidulans FGSC A4
MAGLIRLLRTQFIPPTEPSISFAGKTVVLTGATAGLGFEAAIKMLNLGVESLIIGSRNLQRGEATKTELEQRTNRLGVVQVWELEMSSFQSVKDFAARVESLKQLDVALLNAGIWNREFTTSTEGWEETLQVNTLSTSLLALLLLPKLRSCSTDSSPTHLTVVSSQQFVRVQAKSLRTDGPLLEHLNDARRFSGPKQYGVSKLLLEYVLKSVAAQLHNENGTVPVVVNTVSPGLCVSSLGRQYTGLHHRLVVWIMYKLFARTAEQGSRSLVSATYQGLESHGRRWRSDGYLDESTALTTGAEGKQFQAKAWKEIMAVLKEQSNLAVVLDSNTGVSAN

SEQ ID NO: 18240 - protein, 222 aa, Halobacterium sp. NRC-1
MSKHSNAAHAPGVGRAVDAFRDGQPVLVHDAADREGEVDLIYPAPAVTADAVARMRTDAGGLICVALGDAVADAFALPFIADELDHPAADHGHLGYDDRSSFSLTVNHRDTYTGITDDDRALTIAELGQAAADPAAVDFPATFRAPGHVHVLRAAPSLSARQGHTELGIALAGAAGVPPAVVVCEMLDADTGGARSVADAKRYASRHDIPYVEGSDLVAAFQ

SEQ ID NO: 18241 - protein, 275 aa, Zea mays
IRLEDTASLYRSERAVGDAVAEAARRGIVASREEVFVTTKMWCSQCHPDLVLPSLKESLQNLQMDYVDLYLVHWPIAAKPGKPQFPFKREDIMPMDLIGVWRAMEECHRLGLARMIGVSNFTTKKLQELLAIAKIPPSVNQVEMNPIWQQKRLAEFCKDKGIHLTAYSPLAGQSTSKVNPVMQSEVLQEVAKARGKSVAQISLRWIYEQGASVVVKSFGRDRLKENVEIFDWELTNEDRRKISQIPQHKRVTVLGILSPDGVSSVDLAELDIVEM

SEQ ID NO: 18242 - protein, 429 aa, Bacillus cereus ATCC 10987
MKKFDKSIAAFEEAQDLMPGGVNSPVRAFKSVGMNPLFMERGKGSKVYDIDGNEYIDYVLSWGPLIHGHANNRVVEALKAVAEKGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLEFFAAYYREMVEQGVFLPPSQFEGLFLSTAHSDADIEATIAAAEIAMSKLKA

SEQ ID NO: 18243 - protein, 245 aa, Enterococcus faecium
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGNIPYHLSTQIIKKVVFESHASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTVTYEQVLSIFNSYLLFNGRK

SEQ ID NO: 18244 - protein, 477 aa, Thiobacillus denitrificans ATCC 25259
MIRRTKIVATLGPACSDAKTLDRMMEAGLDVVRLNFSHGVAQDHIDRAELVRSLARTRGRAVGVLVDLQGPKIRIGKFKDNKIVLAKGDNFILDAECALGDQERVGLDYKELPSDVARGVTLLLDDGRIELWVEDVKGSEIHCKVVQGGVLSNNKGINRKGGGLSAAALTEKDIEDIKTAAALKADYLAVSFPRSGADMRQARELLRAAGGRSQLVAKIERTEAIENLEEILDASDAIMVARGDLGVEVGDAAVPALQKRMIRMAIARNKVVITATQMMESMITSPIPTRAEVSDVANAVLDGTDAVMLSAETAAGQYPVEAVQAMDRVCLEAEKEAETQFTRERLDHSFLRADEAIAMSAVFTSVHLNIKAIAALTESGNTCLWMSRLSTRVPIYALTPQVETRRKVTLFRGVYPINLKTATKERDVLLAEAEEELRRRGAVRDGDLILLTIGEPIGQSGGTNTMKIVRVGASKKP

SEQ ID NO: 18245 - protein, 243 aa, Enterococcus faecium
KNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGNIPYHLSTQIIKKVVFESHASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTVTYEQVLSIFNSYLLFNGRK

SEQ ID NO: 18246 - protein, 239 aa, uncultured archaeon GZfos1D1
MKDRSSHDTDGSKSREKEASALSAVTLVADGMIVGIGTGSTAGYAIVELGRLVARGIDILCVPTSYQSEMLAAQQKIPITTLSEHPKLDIVLDGADQIDRNLVAIKGGGAAHTREKVIAHAASRVVLMADHEKVVPGLDHAVPIEVLPYARTLVEREVRALGGIPELRMAARKDGPVVTDNGNFVIDADFGAIDDPARLSGELSALVGAIEHGIFLNVDEVHIGTADGVKVLKRQGLRK

SEQ ID NO: 18247 - protein, 528 aa, Oryza sativa
QIINLCMDKAMAFIPPRDLVVVLPFLALLLPLYIYLRYSRSAKANPSLPTEWPLVGMLPSLVANIHNLFDYATALLAASGNSFEARGPPMSSLRFFVTCDPDNVRHIFINNFANYPKGEEFASFFDVMGDSFFNADGESWRRQRARVQHVMSNPRLLASMAACCRGKVEKGLLPILDRMASAGAPFDLQRLLTRFAFDVTAMAVFGVDTCRLSIDMPPLDVANAMDAVMEVGFFRHTVPVSCWKLMRSLRIGPERKLTAAQRLLRRFVAEMIEKRRVAGGACKATDDEQGGVPPPADIVSSYINDPEYVDEDGNPREFMYATFINYMVAGRDTVGTALSWLFFNLTEHPRVVARIREELEPIASSKAGGGGMVVFDPEETKPLVYLQAALFESMRLYPPGPIERKATLAEDVLPSGHTVRAGDNILIPVYSMGRMASVWGKDSGEYRPERWVTEDGKLRHVPAHRFMPFNAGPRLCLGKDISVLQMKSVAAAVAWNFDLEVVAGHAVEPKVSIVMQIKNGLMVKVKKR

SEQ ID NO: 18248 - protein, 489 aa, Escherichia coli O157:H7 EDL933
  misc_feature (57)..(57): Xaa can be any naturally occurring amino acid
  unsure (1)..(489): unsure at all Xaa locations
MVSETKTTEAPGLRRELKARHLTMIAIGGSIGTGLFVASGATISQAGPGGALLSYMXIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPGKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 18249 - protein, 230 aa, Prochlorococcus marinus subsp. pastoris str. CCMP1986
MHMTCADTKKYLEEFLPLIEEIPNDRKIVIAPPFTAISTFSNYTNFDYLNIASQNIHWEDKGAFTAEISPNMLIEHKVKYAIVGHSEPRKYFSESDEQINKRAVFAQSSGLTPIVCVGETLEQRERGEADRVITRQVEQGLENTDPSNLIVAYEPIWAIGTGKTCEASDANKICALIRSLIGFSDVIIQYGGSVKPNNIDEIMSMSDIDGVLVGGSSLDPISFSRIANFE

SEQ ID NO: 18250 - protein, 529 aa, Frankia sp. EAN1pec
MPVVLVAEELSPAGLEVLSGDFEIRHVDGADRSALLPALADVDAVLIRSATKIDAEALAAAPRLKVVARAGIGLDNVDVPAATNRGVMVVNAPQSNIVSAAEHAIALLLAVARRVPAAHESLVGGEWKRSKYVGVELTEKTAGVVGLGRIGVLVAQRLAAFGMKVLAYDPYVSVARASQLGVRLVDLDELLTSSDVITIHLPKTPETLGLIGADELARVKPGVIIVNAARGGLVDEGALADAVRSGRVGGVGLDVYVKEPTTSSPLFGLENVVVTPHLGASTQEAQDKAGLAVARSVRLALSGEFVPDAVNVQAGGVVAEDVRPGLPLAEKLGQLFSGLAAGVAAAITVEVRGEIAAHDVSVLQLAVLKGVFIDIVEEQVTYVNAPLIAKERGVDVALETSEESPDYRNLVTVRGVLPDGTAVSVSGTLVGSRQVEKITAIDGFEVDLRPEDHLAFFRYEDRPGIVGAVGALLGEAHINIANAQVSRLSAGGEALMSLSLDDAVAPDILAEIAKIIGASYARAVSISAG

SEQ ID NO: 18251 - protein, 66 aa, Arabidopsis thaliana
  misc_feature (41)..(41): Xaa can be any naturally occurring amino acid
  unsure (1)..(66): unsure at all Xaa locations
MPSLQTFLPPELANNVVRLYRECLRRDKFIGKQQNKTELVXGMVRQKKKKNMNETEPEKNQKVFYY

SEQ ID NO: 18252 - protein, 347 aa, Ustilago maydis 521
MAPTATDVRNNEGIANYTKFWQKDSKDDSATDMANRLSEYTSVVNGYYDGATDLYEYGWGQNFHFARYYPGEAFMQAIARHEHYLAHQMGLKPKMRVLDVGCGVGGPAREIARFADVNIVGLNNNEYQIQRARKYTEKAGLSAQVEFVKGDFMKLSEQFGENRFDAFYAIEATCHAPNFEGIYGEILKVLKPGGIFGVYEWCMTDAWDPTNPEHKRIAHGIEVGDGIPEMRSIQNARNALKSVGFQIQHEEDLADRGDKIPWYYPIAGSLSHCQTVWDYFTVARMTKIGRATTQGAVKLLETLRLVPQGTHSVGASLVTAADALVDGGRTKLFTPMMLFVCRKPSSN

SEQ ID NO: 18253 - protein, 541 aa, Thermoanaerobacter tengcongensis MB4
MKITFLGAAKEVTGSCYLVETENARFLVDCGMFQGGEVEDELNYQEFIFDIKDIDFVLLTHAHIDHSGRIPVLYKRGYRKRIYATHATVDLCRYMLPDSGHIQEMESEWKNRKRKRAGKPLRDPLYTAEEAEESISIFYGVDYGEVIEPAPHIKVRFNDAGHILGSSIIEVWVNEKGKETKIVFSGDLGNKKVPLLRDVTPINEADYVLCESTYGNRIHEEVSDRAKRLMEIITRTIKRGGNVIIPSFAVGRTQEILYELHRERDLYKDEIEFLNNIPVYVDSPLATSITDVFAKHPECLDDEAREYIKKGELPLDFPNLHFTHSAEESKALNEIKTPMIIISASGMCEAGRIKHHLKHNLWRPECTVLFVGYQAKGTLGRKLLDGEKDVKILGEDIHVKAEIEYIESFSGHADQRGILEWISNFEKKPKKIFIVHGEDEAQEELADKIEAQFGIETLIPSRYDVYDFDKEELIKGEVEDKEKFKLELNNKLEEMKLRSEKAFNKLQEILDKKDGKDLTGIMLEIDNINESLMKLYRELLD

SEQ ID NO: 18254 - protein, 167 aa, Triticum aestivum
  misc_feature (65)..(65): Xaa can be any naturally occurring amino acid
  misc_feature (83)..(83): Xaa can be any naturally occurring amino acid
  misc_feature (95)..(95): Xaa can be any naturally occurring amino acid
  misc_feature (113)..(113): Xaa can be any naturally occurring amino acid
  misc_feature (149)..(149): Xaa can be any naturally occurring amino acid
  unsure (1)..(167): unsure at all Xaa locations
MSAYCGKYKDELIKNAAYIGTPGKGILAADESTGTIGKRFASINVENVEDNRRALRELLFCTPGXALQYLSGVILFEETLYQXTKGGKPSVDILXEGNVLPGIKVDKGTVRLXGTNGETTTQGFDDLGKRCANYYEAGARFAKWRAVLXDWPTEPSSFHQPSRSGLI

SEQ ID NO: 18255 - protein, 694 aa, Arabidopsis thaliana
MGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFASGKPVPFTAESLAPEVQNSIPSSLTRESPYLTHPIFNMYHTEHELLRYIHKLQSKDLSLCHSMIPLGSCTMKLNATTEMMPVTWPSFTDIHPFAPVEQAQGYQEMFENLGDLLCTITGFDSFSLQPNAGAAGEYAGLMVIRAYHMSRGDHHRNVCIIPVSAHGTNPASAAMCGMKIITVGTDAKGNINIEEVRKAAEANKDNLAALMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKCLEKHYPVLFRGVNGTVAHEFIIDLRGFKNTAGIEPEDVAKRLMDYGFHGPTMSWPVPGTLMIEPTESESKAELDRFCDALISIREEIAQIEKGNADVQNNVLKGAPHPPSLLMADTWKKPYSREYAAFPAPWLRSSKFWPTTGRVDNVYGDRKLVCTLLPEEEQVAAAVSA

SEQ ID NO: 18256 - protein, 264 aa, Thermoanaerobacter tengcongensis MB4
MKIGFIGAGNMGMALIKGILKSDFVEAEDLILYDPVREKVEGLEREFGTVTAKDNLELTEKSDVVIVAVKPNVYDEVLKEIREKVTEEKIIITIAPGITIDHVKKLLGRGKIVRTIPNTPALIGEGITAVTYSEEVKEEDKELVRKIFSTCGEIVEIEEKLIDVAMAVSSCSPAFVYMFIEALADGGVLLGLPRDVAYKLASKAVSGAGSMVFKTGFHPGQLKDMVTSPGGTTIEGIRVLEKSGMRSAVIEAVIAAYQKAKGLK

SEQ ID NO: 18257 - protein, 439 aa, uncultured archaeon GZfos36D8
KLEEEQYTIEEGVPLTSAISPPHYMPPSSSLSYSESELEDLKMPAYEDVLKEAEKNDEFVAFIGPHHSGSGHLRWVMRMKGDIIKDVIPDPGYVHRSMEKIAENRLYIQNVPLTERPNISDPINMNLGYVRAIENALGIEVPERAKYIRTIMAELSRIGAFFYDMGIFPLFMGHSTGFMYSFAIREMVLELMVRMTGSRCTPSFIIPGGIRRDIPDDVLDRTRKFTTAIHKRLKKYENIFVYNPVLISRMKEVGVLTREEAIRCGIVGPFLRASGVEYDVRKAEPYEVYDKLDWEATTGDAGDCLGRIFGRLEEMKQSVEIVRQAVDAVQEMPRGGVISEEILGDYKEASDDIRGYLYNVYGDLVLPKGEWTSVTEAARGTVLYSIISDGESNVPYRVRIITPCWMNLRGIIEASKGERVADFWTVYASFGYFPPEADR

SEQ ID NO: 18258 - protein, 269 aa, Roseovarius nubinhibens ISM
MSGQGGTQRFTILGSGSSGGVPRLGGLWGDCDPENPRNHRRRCSLLIEQEGPEGMTRVLVDTSPDLRSQLLDAGVGHLDAVVYTHSHADHVHGLDDLRMVVFNRGARLDVWADGDTQNALLARFGYAFVQPKGSPYPPILNLCAIDGDIAVDGAGGTITLTPFEVAHGGIDALGFRIGALAYLPDVSEIPEEAWPLLEGLDVWILDALRRTPHPTHAHLARSLEWMHRARPKQGVLTNMHVDMDYATLCDELPDWIRPAYDGMVLTQKV

SEQ ID NO: 18259 - protein, 331 aa, Halobacterium sp. NRC-1
MTHTVAAVLLAGGTGTRLYPASRSHRPKQLLALGDDDRSLLRRTADRAAFADDLLAVTREAYADRVRDEVPEATVLVEPAGKDTGPALAYAASEVRARFGEDAVMLCLPSDHVVGDGFQETAETAVDVAARTDGLVTIGIEPDRPATGYGYIEPGDDHGDHSEVAVFREKPDAETASRLVDRGCLWNAGMFAWTPTAFLDAARSGPLDPLVDALATDADPATAFERVDPVSVDYAVLERAADVRVVPAAFDWDDLGAWNALGRLLDGENAVLGDATTIDATGNVLASDDKHVSVVGVDDLVVAAYDDRVLVVPRADAQRVRDVVAALDAPF

SEQ ID NO: 18260 - protein, 211 aa, Lycopersicon hirsutum
LSDLLSQEKRAEDLQKLLVQLRPFFSLIPKAKTAKIVNKGIVDAVAKIPGTSELQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIMVSQ

SEQ ID NO: 18261 - protein, 148 aa, Bacillus subtilis
MEKTFIMVKPDGVQRQLIGDILSRFERKGLQLAGAKLMRVTEQMAEKHYAEHQGKPFFGELVEFITSGPVFAMVWEGENVIEVTRQLIGKTNPKEALPGTIRGDYGMFVGKNIIHGSDSLESAEREINIFFKNEELVSYQQLMAGWIY

SEQ ID NO: 18262 - protein, 245 aa, Enterococcus faecium
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGNIPYHLSTQIIKKVVFESRASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTVTYEQVLSIFNSYLLFNGRK

SEQ ID NO: 18263 - protein, 97 aa, Arabidopsis thaliana
  misc_feature (31)..(31): Xaa can be any naturally occurring amino acid
  misc_feature (37)..(37): Xaa can be any naturally occurring amino acid
  misc_feature (39)..(39): Xaa can be any naturally occurring amino acid
  misc_feature (43)..(43): Xaa can be any naturally occurring amino acid
  misc_feature (47)..(47): Xaa can be any naturally occurring amino acid
  misc_feature (49)..(49): Xaa can be any naturally occurring amino acid
  misc_feature (56)..(57): Xaa can be any naturally occurring amino acid
  misc_feature (60)..(60): Xaa can be any naturally occurring amino acid
  misc_feature (62)..(63): Xaa can be any naturally occurring amino acid
  misc_feature (65)..(65): Xaa can be any naturally occurring amino acid
  unsure (1)..(97): unsure at all Xaa locations
MASSMLSSATMVASPAQATMVAPFNGLKSSXAFPATXKXNNDXTCMXSXGGRVNCXXVWXAXXKXKGLVWIGGPLSPFRAPVAWVVSDAKARGEGTA

SEQ ID NO: 18264 - protein, 243 aa, Enterococcus faecium
KNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGNIPYHLSTQIIKKVVFESRASDIYLIVEEGFYKRTLDIHRTLGLLLHTQVSIQQLLKLPAECFHPKPKVNSVLIKLTRHTTDVPDKYWKLYTYFVSKLVNREYRQLFTKNQFHQAMKHAKVNNLSTVTYEQVLSIFNSYLLFNGRK

SEQ ID NO: 18265 - protein, 535 aa, Candidatus Kuenenia stuttgartiensis
MLFFWKGSVMLVLIADDLPDVCNEILQNAGVEVLKKTGLKPPELDAVIKMCDGVIVRSNTKLTAPVLEKSEKLKAICRAGVGVDNIDVPAATKKGIVVMNTPAGNIISTAEHTIALLCSLSRFVPQACASVKEGKWEKKKFTGQQLTGKTFGIIGLGRVGRQVAKRAAALEMKVIGYDPFITTEISSQYNIHIVKNLRDLLAQADYITIHVTLNKETKNLITSKEFSLMKKGVQIINCARGGVICEEDLYNAIKTGQVAGAALDVFEEEPPKDNKLLQLEEVIATPHLGASTEEAQYAVAIEAAEQMAAALTGKGYKNAVNLSPYSPEEYASLKSYLALAEKMGSFLTQINNAGIQTLDIVYTGEISHKNIRIVTDSLIVGLLKPSLEEGVNLVSAPTLLAERGIKVNVTTSSNACDFSSLVAAKITTSNGETCISGTVFGKNEPRLVDINGYGVEAILNEQILVLFGRDKPGFIGQVGSLLGNKNINIAHMTFGRKEVGGNTISILNIDAVPPQDCLNEIKQLNHIDAAFLVQL

SEQ ID NO: 18266 - protein, 1776 aa, Cryptococcus neoformans var. neoformans JEC21
MASIFGKKHRTSASSAPHAGPGLAASVPYSQLASGPPPVAGPSGSRSDASRLVSAPSTNPTLTDDGTPGRVSRTPTSNTPTTPRRRTEGSERERHGEGSRRSNASYATDTGRSPSHEYQEMLWRATSESGHHTPIYEAMTSSKSSAFTSPHPARTPGTPSHEFGMRPHPYVAGYGKNPETSSIRSMSSVNSTYDPNNPMSDTGRYPKFETQTVPGANGKSTPTQSTTSLPLPSPLPNRSGEYARPPDHEIEFWYQQILQKTDLDPSRSYMSSPNPSLSRASVSSLGSNSAARSAANLPMDSKWTIVQQYWKSREQQQKHHEAPKALGRKTARGGKGSVEYFLSHALSRTLTPAILFSLEISLRTETLDWIQNFMDHQGQAALVNCLTPLTYTEGSCPPPTDIDEGLMHCLSRSIGKHRIGCADALAKPLMIEKIIPFLTCPNINCRLWAAQILTVLCQVTDPATGDKPGLQIVYSAFAHMQKKVNENVTDLKAKVGRFNLWLSQLAEVLARQGLMGSNVRAHAQVKGLDVIEYCRTMVLLIVSLPTSNDRKTRSSIRNQLDLAVLPIIIQNLRQLHDPEINMQLDIYEENERNDRANMVDQERGTLLKSLKTPEQIIPLLLERTKGSQSSRYLIDILRHFLLIDSDGDEQARYFQLLDELISTIVMGSSPDLHYEFRDAFGKSIAHLFGKLVEHHRVDEAMAEVKELRVVNQRLLIEKQELDEEISAGNDGLVGKLKAQVADLEQRLNRSRVAMEAAVDEKKGMRRDNEQRMRELRLYLQMLYSIILAAGIDIADALESLGFRNAEEMESLLSELGGMEHDEKMWGAEKRKARQFALDKLQNKKVLDGKGSVDVESDGGVDDDGGEEDEAAQVMEAEKIALGGNARGQRKSVRKKPPKVVRPRELRALSQSQFEDAEGEQEQLNVDNRVKEGYDSVSPIRAHFHQSKRRGATPHQQRLGDGLAPPVGEKSVFRSIKKPPPFAPRFVPELSSRPINRSTSAPAQLVDLDLPQLGQDEEEEEGTDRMAKKRESLGAELLARGKGGRQGMGADEGESELSTVMEGEEGKLSSQRESVTEAPKGETTPLPHPPPPPPPPPPPPPPPPPPPPGAIGLTAPPPPPPPPPPPPPLTTLHHPSGPSGAHDLSGVLAGIKGGVSLKKTLGPSIPPPPPPPALPPPSIHTPARAPLGSVSSLLYGANDSRKDVGMIASKKMKQLQWEKVSKAQLGKTVWSKNEEARLEEEVAEKLKMFNVWDKIEDQFKAKEVMYDAIKKRKEQEIISVLAPDHRKRIEILMSGPFTKGFKEDPEGLANAIGDFNADLCVEAFLNELQSVLPSDDDRGKLLTHSADDPKEFSKLHIADRLMVRLIQLPHLNERVKGMLYRVRFPQNIELLEKSLTLLIEACDALMNAKQFQALLSIILTMGNYINGTNYAGGAFGFKITSINRLVDTKSGGGQNLLHFLESTVSTHFKSVEPFLAELEIPSAAARVNYSDLQSTSKQMLDDIYRISESLTTQFDTDKSSYTRQMNAFVSSAAERVRNVRDGIIAADMKLKEVQTFYGEGDGAGVGRGMQSQDFFGIFRTFTSSYKFCQAQNRARAEEQAALEDRARRRAERKAMGITPQPTGMSSVSSQGDFEDVITKLRTQGTPRIPRERPKRAAAPPASPLSESIDFSALLSGMGMDMDAGDGEGVAGEGGGAGGEGDYEALMAQRLLSTTFKSSFESLWGGTEVAEEKEESKGNVKEEEQGEKESENAEKGEEDEDEVRCSATGSLVEELDIT

SEQ ID NO: 18267 - protein, 352 aa, Haemophilus somnus 2336
MSINFVKEGNIMSKYVRSVCLVEPKKVDIKTVLYPKKGECDVLIKVESIGICGSDIGAFRGTNPLVTYPRILGHEIVGTVIEAGVGMPKNINIGDRVILEPYIYCGHCYPCSISRTNCCEALKVLGVHIDGAMQEIVRHPAHMLIKAPDIPIHELALAEPLTISLHAIRRTKVKAGEHVAIIGAGAIGLMAALVAKAYGATPILIDILDKRLDYAKSIGIPNIINPAKENDLEAIKSITNGRMAEVVIEASGANIAVQNTLKYTSFAGRIALTGWPKNETPLPTNLITFKELNIYGARTSKGEFEEALKLLESRKIEPKNIISKVITFDEIPHYIEELSENPDDYLKIIAVF

SEQ ID NO: 18268 - protein, 243 aa, Enterococcus faecium
KNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGSIPYHLSTQIIKKVVFESRASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTVTYEQVLSIFNSYLLFNGRK

SEQ ID NO: 18269 - protein, 243 aa, Enterococcus faecium
KNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGNIPYHLSTQIIKKVVFESRASDIYLIVEEGFYKRTLDIHRTLGLLLHTQVSIKQLLKLPAECFHPKPKVNSALIKLTRHTTDVPDKYWKLYTYFVSKWVNREYRQLFTKNQFHQAMKYAKVNDLSTVTYEQVLSIFNSYLLFNGRK

SEQ ID NO: 18270 - protein, 395 aa, Prochlorococcus marinus subsp. pastoris str. CCMP1986
MAQLETRTEPMVVNFGPHHPSMHGVLRLVVTLDGENVIDCEPVIGYLHRGMEKIAENRTNVMYVPYVSRMDYAAGMFYEAIVVNAPERLANIVVPKRASYIRVLMLELNRIANHLLWLGPFLADVGAQTPFFYIFREREMIYDLWEAATGQRLINNNFFRIGGVACDLPYGWLEKCIDFCDWFAPKIDEYEKLITNNPIFKKRIEGLGTIERDQAINWSLSGPMLRASGVSWDLRKVDSYECYDDFEWEIASEKEGDCYARYRVRVQEMRQSLKIIRQACEMIPGGPTENLEAKRMATEDKKSEIFGMDYQYVAKKVAPTFKIPNGELYTRLESGKGEIGVFIQGNNEVTPWRFKIRAADLNNLQILPHILKGAKIADIMAILGSIDVIMGSVDR

SEQ ID NO: 18271 - protein, 585 aa, Burkholderia xenovorans LB400
MHHGIGFIQDLAVVMALAGVVTVLFHRLKQPVVLGYIAAGVIIGPYTPPFQLIHDEQTIQTLGELGVVFLMFSLGLEFSLRKLFKVGATAIVAALSEIVLMLWLGYEIGSAFGWSPMDSLFLGAILAISSTTIIVKALSELGLKRESFAQLVFGILIVEDILAIAMLVLLSGIAQTGQLSAGVAVVTLGKLLLFMTVSLVVGILVVPRALNYVARAKSDEMLLVSVLGFCFGFCLLVVKLDYSIALGAFLIGAIMAESRHLHRIEHLIAPLRDAFSAIFFVTIGLMLNPAVLVDYAWPIAVITVAVIVGKIVSCGLGTFLAGKDGRTAMRVGMTVSQIGEFSFIIASLGLTLKVTSAFLYPIAVAVSAMTTLFTPYLIRAADPLTQRLSHAMPRTLANVFGMYGQWLDSLSTKTGEPTLFSMTRRIILQIAVNLALVAAIFLIVSYSAPYTSSLLAHWLGSEPMQRVVLWSVALVVSMPFLVAVYRKTKSLALLLAEVSVQPATAGRFTSAIRYAISDLVPVVSMVGVFLLVAALSGGILPPTGLLAAVLVCAALLLALVWRWCVKIHAAMQIALRESFDEQPDP

SEQ ID NO: 18272 - protein, 483 aa, Thiobacillus denitrificans ATCC 25259
MLIFDHSRPGRTAAAQLPATGGDLGDLPAELRRKDAPALPEVSELDVVRHYTRLSQKNFSIDTQFYPLGSCTMKYNPRACNSLAMLPQFLARHPASPDETGQGFLASMFELQEMLKDVTGMAGVSMAPMAGAHGEFAGVAMIRAYHDAKGDAARREIIVPDAAHGTNPATATMCGYTVKEIPTDATGAVDLAALKAAVGPQTAGLMLTNPSTLGVFEKTIAEIQKIVHDAGGLLYYDGANLNAILGKVRPGDMGFDVIHMNLHKTFSTPHGGGGPGAGPVGVSGRLLPFMPIPLVLNDNGFYRLATEADLPQSIGRMSANMGNAGVLMRAYVYARLLGREGMHRVAEYATLNANYLMAKLREAGFDLAYPTRRASHEFIVTLKKLKDATGVSAMDFAKRLLDYGYHAPTTYFPLLVPECLLIEPTETESRETLDGFVDAMKTIKHEAETNPDLVKGAPYTLPVRRLDDVKAARELDLAYKPAA

SEQ ID NO: 18273 - protein, 373 aa, Oryza sativa (japonica cultivar-group)
MAAAAAAASYSSTSWRVRPGLTPFRSPLQPHPQGRLQRIAIFATRIRIATPSAAMQSSSTRHRLEAVNHDHETIPERLAVVTGGNRGIGLEVCRQLALQGVTVILTARDEKRGKDAVESLCHESNLSNIIFHQLDILDGNSRASLARYINSRFGKLDILVNNAGVGGVAVDQDGLRALNIDPRVWLSGKAVNLIQSVIVQTYDEAVKCLNTNYYGLKWITEALLPLLKQSPSGARIVNTTSLRSELKRIPNEKLRDELRNIDIWDEARIEAMLNEFLLDLKNERLEEAGWPTMLPAYSMSKTVVNLYTRILAKRHPEMRINCVHPGFVNTEINWNTGIIPPEEGARGAVKAALLPQDGPTGCYFDQTELGEAW

SEQ ID NO: 18274 - protein, 502 aa, Secale cereale
MDGGGEHSEALKNYYLGKILGVGTFAKVIIAEHKHTRHKVAIKVLNRRQMRAPEMEEKAKREIKILRLFIDLIHPHIIRVYEVIVTPKDIFVVMEYCQNGDLLDYILEKRRLQEDEARRTFQQIISAVEYCHRNKVVHRDLKPENLLLDSKYNVKLADFGLSNVMHDGHFLKTSCGSLNYAAPEVISGKLYAGPEIDVWSCGVILYALLCGAVPFDDDNIPNLFKKIKGGTYILPIYLSDLVRDLISRMLIVDPMKRITIGEIRKHSWFQNRLPRYLAVPPPDMMQQAKMIDEDTLRDVVKLGYDKDHVCESLCNRLQNEETVAYYLLLDNRFRATSGYLGAHYQQPMESASPSTRSYLPGSNDSQGSGLRPYYRVERKWALGLQQSRAPPRAIMIEVLKALKELNVCWKKNGDCYNMKCRWCPGFPRVSDMLLDANHSFVDDCAIKDNGDANSRLPAVIKFEIQLYKTKDDKYLLDMQRVTGPQLLFLEFCAAFLTNLRVL

SEQ ID NO: 18275 - protein, 668 aa, Ustilago maydis 521
MSLKVQLPHSSLCRIGQRTTGAQGGLSSDKAAQKEKVGPLKSGLLFSYMQNFCALQTRLRRPSRTTELDTMDFKPFLTLQHFRPQGFAGDVLAPGASYNQTWNTMASKFNGRGGNRVETGKVLEAASESLKETVPLLQLVVRARHHPLLVFLVGLFLGTIYLLYRYWDCAVGCERRPDLKGPKGLPLIGNLMWALKNRDPLSYQVYAQQKYGYGNTHTLPGLGRLIDISRPDWIEHVQKIKFSNYVKGEQFHDQMRDVLGDGIFTSDGERWKMQRKVASRIFTVSSFKAIITQTIREDCALVEQLIETYARQGTVFNLQELYFKFTLSSFVKIAFSQDIKSLSEPDRPDTFGDAFNYAQKVLDMRFVQPWWKIAERFNETGRKMRAARKIVEEFTTNIVEARRKESEAMGEKSKPESSRKDLLDLFMAYRSSDGQRLSNQQLKDTILNLMIAGRDTTAEALSWMSWHMLTKPDVYDRIRHEIDATLEEEGEQAGLEIDYDVFEQHTAKLTTFQETLRLHPSIPKNIRRALQDDVLPNGGPRVRKGDLMLYSDWAMGRNPDIWGPDACEFKPSRWTDQETGSSIKYSQFQAHFFNGGPRLCLGQKLASYEVVQLIHHIFAKFDLELIDLGPGRSAGFGKVPDYLNSLTHPMKRPLMVKATLRCCKEGTR

SEQ ID NO: 18276 - protein, 464 aa, Thiobacillus denitrificans ATCC 25259
MPFIPHTEEDVSAMLGAIGAASIEDLFDEIPPALKTGKLKDVPDGLPEMAVARLMQERASQDGFWSNFIGAGVYEHHIPAAIWQITTRGEFYSAYTPYQAEASQGTLQLIYEYQTMMTRLTGLDVSNASLYDGASALAEAVLMAVRSHKSSRRVLVPKTVHPVYRSVVVTTVRNQGIDLVELEYDPATGKTVLPSEPGAFAGLVIPQPNFFGVLEDVHTMTDWTHANGGLAIALVNPTTLAVLEAPGKWGTKGADIAVGEGQPLGAPMASGGPYFGFMCCRQDFVRQMPGRIVGRTVDLDGKPGFALTLQAREQHIRRSKATSNICTNQGLVVTAATQYMALLGPQGLAKVAAASHANTVALAEKLGAIPGVARAFASPCFHEVVLKLDDGTLKGTSAKDVLRALRAQGILGGLDISGWYPELGQAILVCVTETKTGADLDHYAQHLERILSKRREAPPCAYKN

SEQ ID NO: 18277 - protein, 470 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATMMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 18278 - protein, 141 aa, Glycine max
MKDEDGTPQSAGKGQYKLWVLGAIILLALWSMFTASLTLKWSAGNLNRDFDSATLNDFDVLEVEEREKVVRRMWDVYTQSKSGRGSGLPRFWSDAFHAAYDHLVSDVQSVRDAAVSEIAKISLHSLPLHHLKSHSVSFFFF

SEQ ID NO: 18279 - protein, 181 aa, Solanum tuberosum
MASSIVSSAAVATRSNVAQASMVAPFTGLKSAASFPVTKKNNNVDITSLASNGGRVRCMQVWPPINMKKYETLSYLPDLSDEQLLKEVEYLLKNGWVPCLEFETEHGFVYREHNSSPGYYDGRYWTMWKLPMFGCTDGTQVLAEVQEAKNAYPQAWIRIIGFDNVRQVQCISFIAYKPEGY

SEQ ID NO: 18280 - protein, 395 aa, Thermoanaerobacter tengcongensis MB4
MNLSQNALQITPSMTLEITAKAKQLKAQGVDVIDFGVGEPDFDTPSYIKEAAIDAIKRGYTKYTPSSGIPELKKAICEKLLKDNGLSYTPEQIVVSNGAKHSIYNALSAILNPGDEVIIPVPYWLSYPEMVRLAYGKPVFVHTKEENDFKITAEELENAITPKTKAIILNSPNNPSGAVYTKEELEEIARVVEEANIFVISDEIYEKLIYEGEHVSIASFGEKIKELTIVVNGISKAYAMTGWRIGYTASSLEVAKVMSNIQSHTTSNPNSIAQYASVAALQGGEEEIEKMKEEFNRRRLYMVERVNKIKDLKCSTPKGAFYVMVNIEKYIGRELNGKTINGSLDFASALIDGANVAVVPALPFGMDNYIRMSYATSLENIKKGLDRIEDFLSKS

SEQ ID NO: 18281 - protein, 459 aa, Thermoanaerobacter tengcongensis MB4
MNLFRKKSVDQLLEAAEKTGLNKKLTAIDLAALAIGSVVGTGIFVSTGEGALRAGPGVIISYIIGGITAALAAFIFAELVTMFPVAGSTYTYSYVAFGELIAWIIGWDLLLEYLVSASAVASGWSGTFVGLLKSFGITLPEAITKPPISGGIMDLPAILITAFVAWILYIGVRESATTNNIIVLVKIGVILLFLFLGFSHVKLSNLTPFAPYGWKGIMSAAAIIFFAYIGFDAVSTAAEETKNPTRDVPLGLVMAMVVILALYISVAVVLVGMVPYKTIIPDNALPGALMSIGINWGSALVATGAAVGMISTLLITLYGQIRIFMVMARDGLLPEVFSHIHPKYRTPHINTVITSLVAAIIAGFLPLDIIIELCNIGTLSVFVIVSIGILVLRVKMPNVERKFRVPAVWLVAPLTAAFSLYLMASLPWVTWLRFGIWMLVGLIIYFAYGRYHSVLNVQK

SEQ ID NO: 18282 - protein, 355 aa, Glycine max
ADPGSFNNSVAEQQAVLETVARVISYVGPPPDEKSFQLHHVFNRAEETPMLIDRKDNVFIISNFKSKYPVLQLDLRLISDLVVAIVSATCGGVAFAFAGQPVITGYLLAGSIVGPGGFNFISEMVQVETVAQFGVIFLLFALGLEFSATKLRVVRAVAVIGGLLQIFLFMCMCGLTVSLCGGKASEGVFVGAFLSMSSTAVVLKFLMEKNTTNALHGQVTIGTLILQDCAVGLLFALLPVLGGTSCVFQGVLSMTKLLVTLIAFLSVLSILSRTCLPWLLKLMISLSSQTNELYQLASVAFCLLVAWCSDKLGLSLELGSFAAGVMIATTDLAQHTLEQIEPIRNLFAALFLASI

SEQ ID NO: 18283 - protein, 322 aa, Leptolyngbya boryana
MAQDQKPTVVITGASSGVGLYAAKALVKRGWHVVMACRNLEKADSAAKSLGMSPDSYTLMHIDLGSLDSVRKFVTQFRESGKSLDALVCNAAVHMPLLKEPMRSPEGYELSVATNHFGHFLLCNLLLEDLKHSTHNDPRLIILGTVTANSKELGGKIPIPAPADLGDLSGLEAGFKAPIAMIDGKPFKAGKAYKDSKLCNMITSRELHRRYHDSTGIVFNTLYPGCVADTPLFRNSLPVFQKVFPWFQKNITGGYVSQELAGERTAQVVADPEFKQSGVHWSWGNRQKEGRESFVQELSEKVTDDAKAKRMWELSEKLVGLA

SEQ ID NO: 18284 - protein, 558 aa, Synechococcus sp. RS9917
MTTARTTAISFDSISDALAAIRNGECVVVVDDERRENEGDLICSAQFASPDQINFMATHARGLICLAMEGERLDALDLPLMVDRNTDANQTAFTVSIDAGPEHGVSTGISADDRSRTIQVALRPDARPADLRRPGHIFPLRARQGGVLKRAGHTEAAVDLAQLAGLIPAGVICEIQNADGSMARLPELRDYARQWNLRLISIADLIRYRLNNERFVRRQAQATLPSLFGSFQAIGYRNELDGSEHVAIIKGDPQQLQEPVLVRMHSECLTGDAFGSLRCDCRPQLESALARIEAEGEGVVVYLRQEGRGIGLINKLKAYSLQDGGLDTVEANEKLGFPADLRNYGVGAQILSDLGIHRLRLLTNNPRKIAGLDGYGLEVVERVPLVIEPGDHNADYLAVKRDKLGHWIHEASTVICWDGTLPADALPQPLAMASEAAAIEGLVLVPVQSPRLLALWERPQFAWRLAEASAEATGEGQTSQAEPLDSRLKRLLSAMATWPITRRIGLYHTSRPDQLNHPPQTLEREERPLEELRTSSPERNGATELPLCSNDVALIQWS

SEQ ID NO: 18285 - protein, 397 aa, Chlamydomonas reinhardtii
MALTMSAKSVSARAQVSSKAQAAPAVAVSGRTSSRVMPAPALAARSSVARTPLVVCAATATAPSPSLADKFKPNAIARVPATQQKQTAIITGASSGLGLNAAKALAATGEWHVVMACRDFLKAEQAAKKVGMPAGSYSILHLDLSSLESVRQFVQNFKASGRRLDALVCNAAVYLPTAKEPRFTADGFELSVGTNHLGHFLLTNLLLDDLKNAPNKQPRCIIVGSITGNTNTLAGNVPPKANLGDLSGLAAGVPAANPMMDGQEFNGAKAYKDSKVACMMTVRQMHQRFHDATGITFASLYPGCIAETGLFREHVPLFKTLFPPFQKYITKGYVSEEEAGRRLAAVISDPKLNKSGAYWSWSSTTGSFDNQVSEEVADDSKASKLWDISAKLVGLSA

SEQ ID NO: 18286 - protein, 522 aa, Ricinus communis
MAGGSLAPAGVAKERAEQYQGKVTFAVFVACMVAAVGGSIFGYDIGISGGVISMDAFLEKFFRSVYLKKKHAHENNYCKYDDQRLAAFTSSLYLAGLAASLVAGPITRIYGRRASIISGGISFLIGAALNATAINLAMLLLGRIMLGVGIGFGNQAVPLYLSEMAPTHLRGGLNIMFQLATTSGIFTANMVNYGTHKLESWGWRLSLGLAAAPALLMTIGGLLLPETPNSLIEQGLHEKGRNVLEKIRGTKHVDAEFQDMLDASELANSIKHPFRNILEKRNRPQLVMAIFMPTFQILTGINIILFYAPPLFQSMGFGGNAALYSSAVTGAVLCSSTFISIATVDRLGRRFLLISGGIQMITCQVIVAIILGVKFGDNQQLSKSFSVLVVIMICLFVLAFGWSWGPLGWTVPSEIFPLETRSAGQSITVAVNLFFTFVIAQSFPSLLCAFKFGIFLFFAGWVTVMTAFVYIFLPETKGVPIEEMIFLWRKHWFWKKIVPGQPEVDDSRESMEMGEAVASRIK

SEQ ID NO: 18287 - protein, 346 aa, Staphylococcus aureus subsp. aureus N315
MARKLHRELNNRHIQLIAIGGAIGTGLFLGSGQTISLTGPSLLFTYMIIGVVLFAFMRALGELLLSNTRFNSFVDIANEYLGPFGGFVIGWTYWLCWIVSSMSDLTAMGQYFAFWYPQVPNWITVLFIVLILISFNLLGARLFGELEFWFSIIKVVTIIAMVIVGLVLIFFSFKTHYGHASFTNLISHGGMFPGGTFGFLMSFQIAVYSFIGIELIGVTAGETKDPEKTLPKAINNVPIRILLFYIGGLLVIMSVIPWNDIDPNSSPFVKLFTLIGVPFAAGVVNFVVLTAAASATNSGIYSNSRILFGLSQQGLGPKVLNWRALFINVSFINCITYSSLVKLHFP

SEQ ID NO: 18288 - protein, 390 aa, Wolbachia endosymbiont strain TRS of Brugia malayi
MSDLKTMMLNFGPQHPAAHGVLRLVLEMDGEIIERADPHIGLLHRGTEKLIEHKTYLQALPYFDRLDYVSPMSQEHAYSLCVEKLLQCEVPIRAKYLRVLFCELTRILNHLLNISSQALDVGAMTPLLWLFEEREKILEFYERASGARFHAAYIRPGGVAADVPEGLIEDIAKFIEQFPQYIDDVDELLTENRIWKQRTVGISEISIKQALDWGFSGPMLRAAGLAWDLRKSQPYEIYDQLDFDIPVGQNGDCYDRYLVRMEEIRQSVSLVKQCIEKIPEGPVKTEDRKISPPPRTEMKRSMEALIHHFKLYSEGYHVPEGEAYAAVEAPKGEFGVYIVSDGTNRPYRCRIRAPGFAHLQALDFMAKGHMLADVAAIIGSLDIVFGEIDR

SEQ ID NO: 18289 - protein, 119 aa, Anabaena variabilis ATCC 29413
MTGNTSGQPMTQISVNELAVYLANEDANIQLIDVREPQELAIAQIHGFVNLPLSEYAQWSEKVPTMFNPEAETLVLCHHGVRSAQMCQWLVSQGFTNVKNIAGGIAAYSLLVDSSIPQY

SEQ ID NO: 18290 - protein, 455 aa, Mycobacterium sp. JLS
MGTRTGMLAQADLERMVSEREIDTVIVAFTDMQGRLTGKRISARLFVDDVAAHGAECCNYLLAVDVDNNTVCGYAISSWETGYGDMVMTPDFDTLRLLPWLPGTALVMADLSWTDGRPVTQAPRSILNRQIDRLAERDLVPYASTELEFMVFDDSFRAAWAAGYRGLTAATDYNIDYAMLASTRMEPLLRDIRLGMEGAGMYCEGVKGECNLGQQEIGFRYDHARVTCDNHTIYKNGAKEIADQHGKSLTFMAKFDEREGNSCHIHISLRGSDGSTVFADEDAEDGMTPLFRSFIAGQIATMREFSLCYAPNINSYKRFAEGSFAPTAIAWGFDNRTCALRVVGQGAGMRMENRAPGGDVNQYLAVSALIAGGLYGIENELELPDPVKGNAYTSGAERLPTTLSEAAELFDRSEIAREAFGDDVVDHYLNYARVELNAFNAAVTDWERVRGFERL

SEQ ID NO: 18291 - protein, 336 aa, marine gamma proteobacterium HTCC2207
MSDTQRKILHILKDGAFHSGEALGEKLGCSRTAVWKHLQKLEALGLVVETTKGTGYRIVGGIDLLDEGLITGALSVEAIPHLSAIDIFQTINSTNTYARELAESSSASGAVILAEQQTAGRGRRGKSWVSPFAANIYLSIVWDFEQGAQALEGLSLAIGVAVKRALTAHGVQEVKLKWPNDIYVEQKKLGGILLEMIGDPVGHCNVIVGVGLNVSMPALQAAAIDQDWTDVTTELQAQQSPADGPKLSVRNKLAAALISEILPLLDTFQTRGFAAYRDEWQAADAFYGQAAEISTPKQSIAGVVRGVETNGALRLELDNGTIESFIGGELSLRLVR

SEQ ID NO: 18292 - protein, 404 aa, Photobacterium sp. SKA34
MQKFGMSSKLNNVCYDIRGPVLKHAKRMEEEGQKILKLNIGNPAPFGFDAPDEILVDVIRNLPTSQGYCDSKGIYSARKAVVQHYQKRGLLDLDVEDVYIGNGVSELIVMAMQALLNHKDEILVPSPDYPLWTAAVSLSGGTPVHYTCDEQSDWYPDLDDIKKKITPNTRGIVLINPNNPTGAVYSRDFLIEVVEVARQHDLIIFADEIYDKILYDGAQHTSIAPLAEDVVCVTFNGLSKSYRVCGFRAGWMIISGPRHRAKGYIEGLEMLSSMRLCANVPMQHAIQTALGGYQSINELILPGGRLLEQRNKAYDLLTQIPGVSCVKPKGALYLFPKLDQKKFNIQDDQKMAMDFLLQEKVLVVHGTGFNWKQPDHFRIVTLPHVDDLELAMGRLERFLHSYRQ

SEQ ID NO: 18293 - protein, 528 aa, Haloarcula marismortui ATCC 43049
MKVLVTDPIADAGLTRLREAGHDVETAYEVEGDALLDAVADANALIVRSGTEVTEEVFAAAPDLIIVGRAGIGVDNIDIDAATDHGVIVANAPEGNVRAAAEHSVAMAFATARSIPQAHDRLKSGEWAKGEFLGTEVNNKTLGVVGFGRVGQQVAKRLGGLGMDIVTFDPYISQERADQFGAELVDDLEDCLAKSDFITIHTPLTPETENMIGEDELALLDGGYVVNCARGGIIDEPALAEAVEDGVLKGAALDVFGEEPLPDDSPLLDVDDIIVTPHLGASTEAAQENVATSTADQIIAAANGQPVANALNAPSLDEATFKQVGPYLDLADTAGRIAVQLFGGHMSEVQVTYAGDIAEEDVEYVTASALKGVFASSDLQVNAVNAPQIAKDRGIDVTESKTRTSEDYQSLITVTVSDGEESVSVCGTQFGGEEPRIVRIDDHRIEAVPHGHMLVVRNRDEPGTIGFIGTVLGEADINIAGMFNGRETIGGEALSVYNLDEQPPQDIIERLNDDSRIIETTYVELGDE

SEQ ID NO: 18294 - protein, 466 aa, Arabidopsis thaliana
MTEVLHFPSSPSASHSSSSSSSSPSPSSLSYASRSNATLLISSDHNRRNPVARFDQDVDFHASIEEQDLRRRSSTDGGEEDDGGEDQISLLALLVAIFRRSLISCKSNRRELCSMEIGWPTNVRHVAHVTFDRFNGFLGLPVEFEPEVPRRAPSASATVFGVSTESMQLSYDSRGNCVPTILLLMQNCLYSQGGLQAEGIFRLTAENSEEEAVREQLNRGFIPERIDVHCLAGLIKAWFRELPTSVLDSLSPEQVMQCQTEEENVELVRLLPPTEAALLDWAINLMADVVQYEHLNKMNSRNIAMVFAPNMTQMDDPLTALMYAVQVMNFLKTLIEKTLRERQDSVVEQAHAFPLEPSDESGHQSPSQSLAFNTSEQSEETQSDNIENAENQSSSSEISDELTLENNACEQRETDFGKYRTGRLSDSSQQVVLNLDPPAQWPVGRTKGLTNLSRVGSRVERTEAWR

SEQ ID NO: 18295 - protein, 335 aa, Rhodospirillum rubrum ATCC 11170
MAVRVAINGFGRIGRLVLRALVESGRKDVEVVAINDLGSPEANAHLIKFDSVHGVLPGDVSVSGDVMTIAGTPVKVLAERDPTKLPWGDLNIDIVMECTGIFSDREKAKVHLEAGAKRVLVSAPSNGADLTVVYGVNHDKLTKDHLVVSNASCTTNCLAPVAQVLHSVFGIEHGFMTTIHSYTGDQRTVDTLHKDLHRARAAAVSMIPTTTGAAKAVGLVLPELAGKLDGTSIRVPTPNVSVVDLKVVLSKTATAEAIGAAMKEAAAGKLKGVLGINELPLVSIDFNHNKNSSTFDLPQTKVVQGTFARVLSWYDNEWGFSNRMLDTAVEMGKLI

SEQ ID NO: 18296 - protein, 487 aa, Zea mays
  misc_feature (444)..(444): Xaa can be any naturally occurring amino acid
  unsure (1)..(487): unsure at all Xaa locations
GACTPDMTPADCQSCLSGIIQTGPKYFSGKQGGRILSVRCNYRYEQYPFFTSTPLLQLAEPTVGAPAPAPAVVNGTPTPPTTGGARGTTGNKTGRVLAITLPIVAAVLATIVLCSCLWRKRKTPGKSALPDTTNPEDIQSIDSLIIDVSTLRAATENFAEANKLGEGGFGSVYKGILPDDQEIAVKRLSQTSRQGMEELKNELVLVAKLQHKNLVRLVGVCLEDHEKLLVYEYMPNKSLDTILFNHERCGELDWGKRFKIVNGIARGLQYLHEDSQVKIIHRDLKASNVLLDNDFNPKISDFGLARLFGSEQSRDVTNRVVGTYGYMAPEYAMRGHYSVKSDVFSFGVLILEIVTGRRNGGSYSSEESADLLSLVWEHWTTGTLVEIMDPSLSSLAPRDLMLKCIHIGLLCVQDDHEDRPMMSTVNVMLSSSTVTLQAPSRPAXFCFPKSGFNSEINSEVYPPGAYQSASRSPMSLNDVSITELEPR

SEQ ID NO: 18297 - protein, 458 aa, Escherichia coli K12
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFMAFKTLRRK

SEQ ID NO: 18298 - protein, 175 aa, Triticum aestivum
MERKQADYSNLDERYTIQGERYQGQQYSHIYYTRLHHMRTLLHALVPSRKPHLLVTTVLGLEEGKDCVLVGTLYKHMKLKPSILDEYSKERSAIPLVKPHNFMHSDDNLILEDESGRVALAGAIPPAAYVTGVVVALHGKETSAGNFLVEDVMEAGLPPQTVLPSINEDKYVVFV

SEQ ID NO: 18299 - protein, 800 aa, Kluyveromyces lactis NRRL Y-1140
MSNPPMNPGNANPLSNIGTPSFSLSQVPQHILQSLTPAQLQMIQQKHQQLLLQRQRQAQQMQQEQVSSPGNMNQLDAAQRAQLMKLKQQQMQRSQTQQQQEQRAQQVQQAQQLQQQQVQQQQQQSPPQSQQRTSLNLPPQIAQLSPALQMQWLQSIKQQAIARNNQNALLMITQLEVKLQQQHRQQQQQQQQPVPPQQPVQQQQHQSPPRNIIPPNQPQLQQPQPQKPRIPLQQQMGNPQQMIGGQPITQNIPVMNSNQSMVPSSQQPQSQPPQPPQRQPPQRQQQQQVPVSVPQPPQPSQAAILQQVLQKFQKQLPDIPKFQTILQDPPETPLPHTRLWSEKERADNEPVSFDTRLYEHVIERDLLDKDNLLADTNGLEPISKFGFSQREVILRLQQDLDYYKELRNSRMQSITNTTQGHKSKSIWGDGYSGYGNGFSNDLTRIQVDDTYEMHLDEIYEWTMNQTGEELVPVRLEFDAEKDKFTLRDTFVWNRSDTLLSINEFVKTTLKDYRLKVTTEMYQQIVNSIKEQLQEYTPNPFENVQRFGGDDFRIKINLDIVVGQHQLIDTVEWDVSNPDNCPESFAECLCEELSLPGEFLTAIAHCIREQVHMYHKSLYMVGYKFDGSPVEEDDIRTRFLPVLTLADVMRPQKDTFLYTPNLLQISPAELERLVKDKDRDTRRKRRQVRFNRRGNTENHPSSGSTPQLPHDAELPDLGDIPKTCRQLLPTTTLPGGIDVGPSTLSFQPSTRVEYLDRAKATPKQEFQQEVRNSSACRVIMHDVGKSLLVTIKLPKAKTTIQ

SEQ ID NO: 18300 - protein, 187 aa, Candidatus Pelagibacter ubique HTCC1002
MKLKKFNFKTVNSTNDLAIQIIKKTNNKSGIIIAEKQKKGRGQYGKKWTSFKGNLFVSIFFKINKVQLSLKDLTKVNCLLVKKLLSKFYNGKITIKKPNDLLINRMKISGILQEILTKSGEKFIVVGVGINLTKSPIIKNYLTTNLFDLTGTKITPNYAALRLKKIYETFIPMFPKFNIKNLDRNLK

SEQ ID NO: 18301 - protein, 356 aa, Salinibacter ruber DSM 13855
MSHALSDGPAPSGALESVMTLEQFILDRRGRFPQSTGAFSRLLRDVSVAAKIINHNIRRAGILDVMGESGTVNVQDEKQKKLDEIADRELERALRRGGECCLVGSEEQADTISLSPRGDFQERFAVFFDPLDGSSNTDVNASVGTIFSVYTLPEGADEGDALDVALRPGAEQVAAGYVAYGSSTMFVFTTGNGVNGFTLDPGIGEFLLTHPDLQIPQAPAMYSINEADIEDFSPELRAFLQWLKTKDPDTGHRIRARYIGSFVSDFHRNLLTGGLYMYPATSDHPDGKLRLMYEANPMAFLVEQAGGRASTGHQRILDLQPEGLHERTPLFIGSAPLVKAAEAYLQGRGAEAVGGA

SEQ ID NO: 18302 - protein, 174 aa, Triticum aestivum
MAPAVMASSATTVAPFQGLKSTAGLPVSRRSRGSLGSVSNGGRIRCMQVWPIEGIKKFETLSYLPPLSTEALSKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 18303 - protein, 395 aa, Triticum aestivum
  misc_feature (167)..(167): Xaa can be any naturally occurring amino acid
  misc_feature (206)..(206): Xaa can be any naturally occurring amino acid
  unsure (1)..(395): unsure at all Xaa locations
METVAAAGYARGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPXVEGGFSVAFDPLDGSSIVDTNFTVGTIFGVWPGDKLTGXSPGGDQVAAAMGIYGPRTTFVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 18304 - protein, 1156 aa, Cryptococcus neoformans var. neoformans B-3501A
MARTGSRRRIDQLDSDNELARPHQSSQFKRAKTEPGTGDISSSDFNSDNDDAGMDMDDSSDESEYEEPSYEEEALLAAYSDLRRSQKGYVGSASSAGIIKSISLIDFMCHRHLTVDFGPRMNFVVGHNGSGKSAVLTAIAVALGGKANLTGRGTGLKDLIRTGAERAVITITLANSGDSAYRPEVYNPNIVIERTIHSNGSSGYKFKASKDGKTIANKRSELTSISDYFNINIDSPLTVLTQDQSRSFLQNADPSKLYKFFLNGTQLSNLLESYEASSQNIESLVNFIKRQREALPDLKAKVESYKRKIQASKKVMRQKRRNKQLLIELAWSYVIEKEKARDEKKSDVLELREKIEKVQEEIHKTDKELPQVNDAILETESDLKNLDESSKPLALAVRQAKARSQEASKELRSMQSSVAEIEEKIISEKSTLERLERKIEEQLRLNEPEQQEERRRLLQRRAKAEDILSKLQLERPARERERDDKFQAQKRAKEELQSINANLRDVNQSKAQMQRQIQNISRQANSRIAAFGLHIEPLLEEINSTNWKHSKPIGPMGMFVHLEDMRYADVLQVMLGSALCSFAVRDHEDRVKLSNILSKHFARGYRPGNFTARDGARIPTIYRHSGELFDFSNGDLSRHGPTILSKLRIENEEVLRILIDHHNIEKTMLAPTLIEGNRLMDDLLNKNVAQFVTVHCADLMTTSGTKSNRHSGPTNKYRGNPLFALDVGSEIAKCEAQLQDYESQCQQLCNSASMTENRIASLQQDMAKLSAGITDLQKKMIPLEKDLDQTKRKLADMASTEIDTSESIRDDLKERINELEMKLQEHNADIIKQEDVIKQLDADVVQKRAAFDAQAPTKELLLKNLESQVQRRTNILTRQSHWAQSLINYETKLEEAEEILVDLEQNVQEWTNKALDYAPEKINTIKTPAELEAERKALDQSITEASRALGVNLDELTAEYRLQRQRYQKANENIKDLNFLRIVLRKAMTNRHTWWHQTRSHIAIRAKTAFVVFESFRAMEGRLNFDHGHEKLSLVIHNQTTTESQDGTYTQISHYKGAKALSGGERSFSTVSLLLALWSTVPCPIRALDEWDVFLDAANRKVAAKNLMEGARESDGKQYILITPLDMQGIDTSGPDKKVIRMADPERGQGTLNMSR

SEQ ID NO: 18305 - protein, 411 aa, Brassica napus
MAATAGATPSSHLLLSSSRHVAASPQPRILFPSLSGKRVAVGKNHHATGVRCMAVAADATAETKPAAKKKSGYELQTLTSWLLRQEMKGEIDTELTIVMSSIAMACKQIASLVQRAGISNLTGVQGAVNIQGEDQKKLDVVSNEVFSNCLRSSGRTGIIASEEEDVPVAVEESYSGNYVVVFDPLDGSSNIDAAVSTGSIFGIYSPNDECLPDSDDTSALGSEEERCIVNVCQPGNNLLAAGYCMYSSSVIFVLTLGKGVFAFTLDPMYGEFVLTQENIEIPKAGKIYSFNEGNYQMWDENLKKYIDDLKDPGPSGKPYSARYIGSLVGDFHRTLLYGGIYGYPRDAKSKNGKLRLLYECAPMSFIVEQAGGKGSDGHHRVLDIQPTEIHQRVPLYIGSKEEVEKLEKYLA

SEQ ID NO: 18306 - protein, 446 aa, Candidatus Protochlamydia amoebophila UWE25
MDFISNKTPQIEAMLTEIGIQNVEELFKSIPSSLILQAPSVDDGLSEYEGIQLIESLAVRNTFPNLVSYLGAGAYEHHIPALVGAVCSKSEFLTAYTPYQAEASQGMLQIIFEFQSAICALTGMDVANASVYDGASACAEAILMSLRHHKTRRQILLSDSLHPHYKKVIEQYLKSQDCELITVPFLQEGTLDASFLKMYLNDQTAAILLQSPNFFGCIEDVQPITEMAKSQGALTILCANPISYGLLSSAKELGVDIAVGDCQPFGLSLSFGGPYAGYMACKQELMRQLPGRIVGETLDVQGSRGFVLTLQAREQHIRREKATSNICTNQALAALASLVAMLWYGKEGVKELALTNYQRANYLKFHLGKISTINVWNQGASFNEFVVDFKQDSNQVLEFFRLNGIEPGIELKRYYPSLKTCLLIAVTETKNQIQLDQFIKVCKELF

SEQ ID NO: 18307 - protein, 163 aa, Gloeobacter violaceus PCC 7421
MIESTQPATRRGYLMKFLVAIDGSETGLSALAKALELAKPTGASLLLLTVAEQANATFWPGMLPTGEPLYQGPPLAELEQIARSVGEAALEKGAKLCEAAGVDYQTRLEFGHARDTICEVAEQEKPDILVIGSRGLGSVQRLMLGSVSDYVIHHAHCPVLVVR

SEQ ID NO: 18308 - protein, 457 aa, Listeria innocua
MNQNPVEEGQKFPLTIRRMGINGEGIGYFKKAVVFVPGAITGEEVVVEAVKVRDRFTEAKLNKIRKKSPNRVTAPCPVYEACGGCQLQHVAYNAQLELKRDIVIQSIEKHTKIDPAKLKIRPTIGMEDPWRYRNKSQFQTRMVGSGQVETGLFGANSHQLVPIEDCIVQQPVTIKVTNFVRDLLEKYGVPIYDEKAGSGIIRTIVVRTGVKTGETQLVFITNSKKLPKKREMLAEIEAALPEVTSIMQNVNQAKSSLIFGDETFLLAGKESIEEKLMELEFDLSARAFFQLNPFQTERLYQEVEKALVLTGSETLVDAYCGVGTIGQAFAGKVKEVRGMDIIPESIEDAKRNAEKNGIDNVYYEVGKAEDVLPKWVKEGFRPDAVIVDPPRSGCDQGLIKSLLQVEAKQLVYVSCNPSTLARDLALLAKKYQIRYMQPVDMFPQTAHVETVTLLQRR

SEQ ID NO: 18309 - protein, 149 aa, Crocosphaera watsonii WH 8501
MERTFIMIKPDGVQRGLVGEIIGRFEAKGFTLVGLKSLSVSRELAEEHYDVHKERPFFGGLVDFICSSPVVAMVWEGDGVVASARKLIGATNPLSAEPGTIRGDFGVSVGLNLIHGSDAIETAQKEINLWFSEKELLSWEPTVNAWLYE

SEQ ID NO: 18310 - protein, 415 aa, Myxococcus xanthus DK 1622
MADTLKPEAPNPDTDAYAHESELDAHLQTKRMVINMGPSHPATHGTVRLKVELEGETIVKIDPEIGFLHRGFQKSCENVTWTQCLPYTDRLNYLSAMMNNFGFLNAVEKLIGLEIPERAQYIRVIGSELHRLTDHLTCVGATGLEMGGFAPFLLAMEFRELLHDRTAELTGARLTTSFGRVGGSNRDLPEGWIPRVHKTLDQGLALLDEMEGLLTNNRIFVDRTKGTGVISAEDAIEYGYTGPALRACGVDYDIRKTKPYWVYDRFDFDIPVGEHGDNYDRYLVRLEEMRQSIRILRQAMDTIPAGPIIVDDWRIALPPKPEVYGTIEGVMSHFKLVMEGIQVPAGEVYDATEASNGELGWYLVSDGRGRPYKVHVRAPGFPVLAAVPHIIEGKMLADLIPTFDTINMIGGEVEQ

SEQ ID NO: 18311 - protein, 537 aa, Oryza sativa
MAPAAAGRVPLSRRRSTAALLLVALALVLGVQLRSAAARPDKEMREKFYGKLVTNGSGNATGDGSIAEMFGRVLDKEFSDSDTPEAPDKSSFNNSISDHQAVLETVAVITHDKKKNDSEQANSSKPFQIGDMFGGQNENSDDLETVIDKEDNVFVMSNRKTKYPTLQLDLRLIKDLVVIIVSATAGGIIFSCLGQPVIVGYLLAGSLVGPGGLNFISEMVQVETFAQFGVVFLLFALGLEFSLTKLKAVGPVAVIGGLLQIVLFMFLCGLTAALCGAKSSEGVFVGAFLSMSSTAVVSKFLVEKGSTNALHGQVTIGTLILQAACIIRIYNCCIYDDLVICSSILETDDSAIIAVRSQYHTNELYQLASVAFCLLLAWCSDYLGLSLELGSFLAGVMISTTDFAHHTLEQVEPIRNLFAALFLASIGMLIHVKFLWNHVDILLAAVILVIIVKSVVVTVVVKAFGYSIRTAFVGKMYLLLLGTTALSLVTTPLIFKLIPVVMHLGILMRWFPSESSMQNELPLQDKATMLEAYNRSL

SEQ ID NO: 18312 - protein, 288 aa, Prochlorococcus marinus subsp. pastoris str. CCMP1986
MEIPKIQWYPGHIAKAEKKLTEVINRVDLVIEVRDARIPLSTGHPHLNQWIRNKKHILVINRADMISTETITNWNKWFKKDNIYPLWCDAKNGKGIKEICKSAKESRLSIDNKRLSRGMKVRPIRALTLGFPNVGKSALINRIAKKKVVESARKAGVTRNLRWIRLDNGIDLLDAPGVIPPNLENQKSALNLALCDDIGEAAYEIESVAIEFIKIIFKLKEDKNANISLSKISDRYGVDILKNFDNPHEWIDLVALKHTSGDKRRMAHKLLEDYRNQMLGKISLEVPR

SEQ ID NO: 18313 - protein, 402 aa, Oryza sativa
MGDFNVALVIVAAVVSVLVLLVSVYLLINYQHPDDANQAYFPKLVVVLGITVALLSILMLPADVANRQACRRAIYSGACSLTLPMKTLWLAVYIADAVLVFLVIPFAMFYYEGDQDKSVGKRLTSALLWVAVSAVVCGLILGILYGLVGKVDFTVRHLSSAVETFPNSFTSFSTGQPCISTSPKQCAAYTAPANSQTTWTMRATFPEYVVALATIVGSVLFTEATELGKKARELKKAAEALHQEEKSGKKGRKWRKNVKALGKELVLLEDDMKALEEMYPQGEQAEATWALTVLGYIGKLLFGAVGWGGTLMNSFLFNVGLILLCSISVIQFCATAFAYYAQATAAQEIFGHTLQSLRGIKYLYKYNVFQYGFVALAILTLFYYAIFGWRKRKPTGRFQLSN

SEQ ID NO: 18314 - protein, 541 aa, Ustilago maydis 521
MISLVQHSFDFFETRLGLAVGFIITLALVYRDRAVFVAKCDHIKGPPGLPLLGNTLQVFKEAADPLQAMLSRSAVYGLPNTMTVLGMGRAINITRPDWIQHVQKTNFSNYVKGPKLHTCLKDLLGDGIFNADGHSWKAQRKVGSNIMTMSNLKNLVAGVLDAQSQRFSDLLQQAAKQGTPIDLQKAYFDFTIQTFLRIAFSTDLETVQSTRIATRSEQQKAAQHLSFADAFDLAQRLTVRRINRPWWKLTRRWEPSEKKLEHAIRTIDRYLYPLIERRSQNKSKADKRHADLLDLFLSYRDDQDQPLTPKQLRDALLNYLLAGRDTTAESLSWASFELLRHPEVVHDLRQELMSHSIWFDPHQKIDDDDAEQRSSSFELSHTKQLHHVRSIYHESLRLHPSVPRSSKIALQDDVLPGGVVVPKDTTVIWSDWLLARNKSVWGDDADEWKPRRWLNAEGEFINESPWKFHAFNGGPRTCLGIQLAQFQGMYMLSRIFSDFDLELESDRGLHFEPEVENTLTLPMKHPLMVRVYTRAKTSRAP

SEQ ID NO: 18315 - protein, 575 aa, Yarrowia lipolytica
MKLFKREAPQGTVRTSYFGSRGTRLHRIIAAVAGIGFLLFGYDTGVMGSLLTLPTFIHQFPTMDSTSPHLDAKTKSFHSTVQGTAVAIYEIGCMLGALFTMWGGDKLGRRKIIFIGSIIVTIGAILQCASYSLGQFVTGRVIAGIGVGFTTATVPMFQAECARPERRGALVMLGGALTTGGIALSYWIDFGFYFVKRNDSDWRFPVAFQILFSLILSCTVLYLPESPRWLIKKGRYEEAAGVFAALEDVPIDDIYVSQQLMQVKESLMVGQLAQEGIEGDEARRRIASGDVELGEEPPFRKQLVLLFTFGKKKHLHRAMLAYSQQIMHQMCGINLISYYAAYIFQTSIGMSPLNSRILAACDGTEYFLASWIAFYTIERFGRRKLMLFGTIGQACTMAILAGTVYAASSVKDGGLDKPQAGIAAAVFLFVFNTFFSIGWLGMAWLYPAEIAPIEIRAISQGLSTSGNWVFNFLVVMITPVAFNSIKWRTYIIFACINVAMVPSIYFFFPETMGRSLEEIDLIFEDSNPRTPWDVVGIAKRLPRGTLDGVVPSDMELEKEIEHVSVKSLGGATIRG

SEQ ID NO: 18316 - protein, 392 aa, Bacillus subtilis subsp. subtilis str. 168
MEHLLNPKAREIEISGIRKFSNLVAQHEDVISLTIGQPDFFTPHHVKAAAKKAIDENVTSYTPNAGYLELRQAVQLYMKKKADFNYDAESEIIITTGAQAIDAAFRTILSPGDEVIMPGPIYPGYEPIINLCGAKPVIVDTTSHGFKLTARLIEDALTPNTKCVVLPYPSNPTGVTLSEEELKSIAALLKGRNVFVLSDEIYSELTYDRPHYSIATYLRDQTIVINGLSKSHSMTGWRIGFLFAPKDIAKHILKVHQYNVSCASSISQKAALEAVTNGFDDALIMREQYKKRLDYVYDRLVSMGLDVVKPSGAFYIFPSIKSFGMTSFDFSMALLEDAGVALVPGSSFSTYGEGYVRLSFACSMDTLREGLDRLELFVLKKREAMQTINNGV

SEQ ID NO: 18317 - protein, 509 aa, Magnaporthe grisea 70-15
MAQPLSSAVQPTDIYGGDEVSALVLDPGYCYTRAGFAGEDVPKSVLPSFYGHTEDGRDLFGDDVMLPRPGFEVRNYLSRESIVEDWDVAQKMWEHMLVKRMQPDRAHLLGRKPPKPKQSQPQQPSKDKEGDVEMGGADGDAAPAATEEAAAAAEEDELLELALGENPLLMTESPWNTPKAREKAIELAMEGWGVPAFWLTKTPVLAAFAAGKATALVVDCGGANTSVTAVHDGMVLKRSVQRSQVGGLWLSDQIRRMWDSQDPRVRATPHFMVENKTPVDAGVEPNVRLRKFDFDVHPSFRAYEEERLLTEFKESVVEVWRGPQKFTAPGTEDYIKSQPGRVFEMPDGYNQMWREQRYKVAEGMWDEAAAYPAASGSSSSNGNGATSTPTPAGAAAADGAAKVQTIPDLISACLNGVDQDLRPNLLANVVVTGSTSLLNGFNDRLNGELSAKYPTLRVKLHAAGLTTERRFGSWIGGSILSSLGTFHQMWISRKEYEENGPGIVEKRCK

SEQ ID NO: 18318 - protein, 364 aa, Arabidopsis thaliana
MGKGGMSQGEGSKVEEENMAAWLVGINTLKIQPFLLPSVGPHDVRVRMKAVGICGSDVHYLKTMRCADFVVKEPMVIGHECAGIIEEVGEEVKHLVVGDRVALEPGISCWRCNLCREGRYNLCPEMKFFATPPVHGSLANQVVHPADLCFKLPENVSLEEGAMCEPLSVGVHACRRAEVGPETNVLVMGAGPIGLVTMLAARAFSVPRIVIVDVDENRLAVAKQLGADEIVQVTTNLEDVGSEVEQIQKAMGSNIDVTFDCAGFNKTMSTALAATRCGGKVCLVGMGHGIMTVPLTPAAAREVDVVGVFRYKNTWPLCLEFLTSGKIDVKPLITHRFGFSQKEVEDAFETSARGSNAIKVMFNL

SEQ ID NO: 18319 - protein, 364 aa, Cryptococcus neoformans var. neoformans JEC21
MSLWSNIWLWIRYQVNVIIHCGFPCFFWVQPTWSIDKIENQEGKVVLITGGNSGTGYATALALYNAGATVYIACRNLTRAKEAAEDIKKGGERGIWGVTYPRKELDKAGGNKKGRVEIIQLDLTDLASVEKCAEEFLNKEKKLDLLFANAGIMATPEGQYTKQGYTLQFGTNTLGHHRLITLLLPLLLSSPPSLPSRVILTSSAGHSMAPKGGVNFKSVVRDPSDTGSGQGKYELDKWTEYAQSKWGNIASAKYLEDTYGKEGRLIAVAVHPGLVATNLTNHLPFVGIFYRWVPWLRHLFTRDPSTGALNQLYAATLPLPDAWFLNGEYVVPYNTVGICRSDLLDKKRIEEVWNWCDEQGKKFA

SEQ ID NO: 18320 - protein, 158 aa, Brassica napus
MPQGDYIELHKKRHGRRLDYEERKRKKEARQVHKRSKQAQNSIGIKGKMIAKKNYAEKAQMKKTLKMHEESSSRRKADEDVQEGAVPAYLLDRENTSRAKVLSNTIKQKRKEKAGKWEVPLPKVRPVAEDEMFRVIRSGKRKTKQWKRMVTKATFVGP

SEQ ID NO: 18321 - protein, 139 aa, Thermoanaerobacter tengcongensis MB4
MIFMEVTLAIVKPDGVKRGLIGEILKRYENKGLRLKAAKVVTPSIELLEKHYEEHKGKPFFKPLIEYMSSGPVFAMVLEGENAVKLVRMINGATKVEDALPGTIRGDFASSTTYNVVHGSDSVESAKREIALWFPELIL

SEQ ID NO: 18322 - protein, 391 aa, Candidatus Pelagibacter ubique HTCC1002
MTKKIKTLNLNFGPQHPAAHGVLRLILELDGEVVEKADPHIGLLHRGTEKLIENKTYMQAVPYFDRLDYVAPMNQEHAFALAIEKILKINVPIRAQLIRVMFCEIGRILSHILNVTTQALDVGALTPSLWGFEERETLMTFYERASGSRLHANYFRAGGVHQDLPMGLEEDIGNFCESFPKIIDDLETLLTDNRIFKQRNVDIGIVTKEDALDYSFSGVMIRGSGVPWDLRKSQPYDCYEQLEFKIPVGKNGDCFDRYLCRIEEMRESVSIIKQCLSKMEKGPIKSLDGKISPPPKKDIKQSMEALIHHFKLFTEGYRVDKDEIYTAVEAPKGEFGVYLISDGTSKPYKCKIRAPGFSHLQAMDYLIKGHMLADVPAVLGSLDIVFGEVDR

SEQ ID NO: 18323 - protein, 175 aa, Triticum aestivum
MAPAVMASSATTVAPFQGLKSTAGLPISCRSGSTGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 18324 - protein, 564 aa, Pichia angusta
MTIESQEPWWKSAVVYQVWPASFKDSNGDGIGDLNGITSELDHIKSLGTDVIWLSPHYASPLDDMGYDISDYNAINPQFGTMEDMDRLLAEIKKRDMRLILDLVINHTSSEHAWFKESRSSRDNPKRDWYIWKDNANNWLSFFSGSAWSYDEKTKQYYLRRFAETQPDLNWENPKTREAIYKSALEFWYEKGVSGFRIDTAGLYSKVQTFEDAPVTFPGEKYQPAGPLINSGPRIHEFHKEMYEKVTSRYDAMTVGEVGHCSKADALKYVSAKEKEMNMMFLFDTVDVGSDKSDRFRYKGFTLTDFKDAIINQSNFIFDDETGELNDAWSTVFIENHDQPRCVTRFGNTSNKLFWSRSAKMLALLQTTLTGTLFVYQGQEIGMTNVSPKWDISEYLDINTINYWNAFNETEHSDEEKAELLKIINLLARDNARTPVQWDSSENGGFGGKPWMRINDNYKDINVASQKEDPDSVLNFYRNAIKTRKHYSETLIFGRFEVQDYDNQEIFYYTKTSNKGQKKMAVVLNFTDREVEYPIPQGKLLLSNIANNITGKLQPYEGRLIEVN

SEQ ID NO: 18325 - protein, 438 aa, Cryptococcus neoformans var. neoformans B-3501A
MSTRQDKSTTERHAKILRELVKQPGNKNCADCKRNDTRWASWNLGVFLCIRCSGIHRSMGTHISKVKSIDLDIWTPEQMESIQKWGNKRANMYWERHLKAGHIPSDHKIESFIRSKYETRRWAMDGPPPPDPSVLENESTGGVVSPPPHQTKSPAPIPSSTSSSAAPPVPAHLPKTHPLLSRSIASSKATPSKPTSAVQAPIIDLFADDPAPAPAAVPAASSRAPAPIATAPAPAQPAPSSASNIFDLDFRTPSAPPLSNSPPASGPISNKSQSAKADIMSLFSSPSPSAIQSQQPNLAGGFFNATPSGVQATSPYASWQGGITSAVPSDGTQLGIPVGNKWSGLQMDQNAWGAPQHAQATQKTQPTQAYAQPQQQQSVNNMVSDPWTQAKTSMASPSDPWASTSSGDAGMGGGFFGMNQAQPKKEKDERDPFANIWA

SEQ ID NO: 18326 - protein, 279 aa, Magnetococcus sp. MC-1
MSHYGRIKLLLEQHGLSPNKRFGQNFLVDPSVAPRIVALAGIKAGDRVLEIGPGVGSLTIPLLQKAGAVTAVEKDRKLLPLLRVEAAGVGALTLVEEDALLVDYTALAQQLGGPLKLAANLPYNISTPLMVHLLDHHAAFECMALMFQKEVAQRLAAEPGSKAYGALTVQCALWAEIRHGFDVPPAAFLPAPKVTSAVVHVQMMRQPRVAVEDERHFVRVVKAAFAQRRKTLRNTLKTICPDPNRWLEQAGIDGALRAEVLTLAQFAQLANTPMPTSAP

SEQ ID NO: 18327 - protein, 410 aa, Yersinia pseudotuberculosis IP 32953
MPRHIYIATTTDTKGQELAYVSELIQATGLTTVTVDLSTKESQRDSGADICAETVAGYHPDGRQAVFCGDRGQAINAMAIAFERFMVSRVDVAALLGMGGSGGTALITPAMQRLPIGIPKLMVSTMASGDVSGYIGASDIAMMYSVTDIAGLNRISRRVLSNAAHQVAGAVYFAQEASPVDDKPALGLTMFGVTTPCIQAVSAELSDEYDCLVFHATGSGGKAMEKLAESGLLAGVLDLTTTEVCDLLFDGVLACGPERFDAIAHTHIPYVGSCGALDMVNFGSPATIPAKYADRLFYKHNAQVTLMRTTEQENIEMARWIGEKLNRCQGEVRFLIPEGGFSALDAPGQPFWDEKALTAFIRTLEETVIQTDKRRVVHYPFNINDPLFAQAAIENFKEIVNKEIVNRPSH

SEQ ID NO: 18328 - protein, 639 aa, Candida glabrata CBS 138
MPPKTEPKKWKPPKGPKPIQRKNKNPIGLGRAIMHQRSKENTIEYLPDGEMRFTTDKHEANWVKLRSVTQESALDEFLNTAALADKDFTADRHSNVKIIRIDNGDGSATSQGFSLTNEQKSTIDAKQRALANDLIVPRRPYWDESMTKYQLERQENDAFLEWRRKLAHLQENNEDLLLTPFERNIEVWKQLWRVVERSDLVVQIVDARDPLLFRSVDLERYVTEVDDRKQNLLLINKADLLTRNQRITWAKYFAKKNNSYAFYSALRANQLLEKQKELGDDYSEEHIEEESDDSEETLEESVREGIKILTIDQLEELFLSRAPSEPLTEPLPGQESLLQIGLVGYPNVGKSSTINSLVGAKKVSVSSTPGKTKHFQTIKLSDHVMLCDCPGLVFANFAYNKGELVCNGVLPIDQLRDYVGPCALVAERIPKYYLEAVYGIHIQTRSREESGDIEPENPTAQELLVAYARARGYMTQGFGSADESRASRYILKDYVNGKLLYVNPPPHLEDDTPYTREECKEFNKELYVFDKLPETRQEQLREAAKAKGIEVLDLARDLSKLTFSAHTAAEANKKASSVTHGGKQAALYNAADDLDREFFNMNKVEGKLTTPFHKQQSQSGSKKHNKKNKKGKVRNLNFE

SEQ ID NO: 18329 - protein, 478 aa, Roseovarius nubinhibens ISM
MYSYPELKLFINGEWRGAAEDMAVVNPATEEELGRLPKAGISDLQEALAAAEQGLRLWSRTPPRARADIILRAAALMRERQEEIAQSITAEHGKPLPQARLEVIRGVEFFEWDAGEAMRVYGRVIPAAPGSHISVHHHPIGVVAAFSPWNFPMSQPARKIAGALASGCSIILKAAEETPAGAIHIVRAFEDAGLPAGVLNLIFGTPSEISGYLIPQPSVRLVALTGSTAVGRQLTALAAQSDTRVLMELGGHAPVIVCEDTDVERAAISGAVRKMRNAGQVCTSPTRFFIHQDIFEQFAEAFTRRAAATVVGNGVEPGVEMGPLANDRRVPVLSALVEDAVAKGAELRCGGAAMGERGYFFAPTVLANVPDNARIMQEEPFGPIAILNPVRDLDEAIARANAVPYGLAGYGFTNRADYMARLVDEVEVGNLSINTLEASLPETPFGGVKASGYGREGGTEGLESYLTIKNVWHSAEIR

SEQ ID NO: 18330 - protein, 218 aa, Vibrio parahaemolyticus RIMD 2210633
MNQSSLLAEFGDPITRVENALIALKEGRGVLLLDDEDRENEGDIIYSVEHLTNEQMALMIRECSGIVCLCLTDAQADKLELPPMVVNNNSANQTAFTVSIEAKVGVTTGVSAADRVTTIKTAANPHAKPEDLARPGHVFPLRARPGGVMTRRGHTEGTIDLMQMAGLQPAGVLCEVTNPDGTMAKAPEIVAFGHLHNMPVLTIEDMVAYRNQFDLKLA

SEQ ID NO: 18331 - protein, 572 aa, Wolbachia endosymbiont strain TRS of Brugia malayi
MHSGSQHLFDIIILLSAAVFIVIAFWKMNISPVLGYFVAGALIGSHGFNLIHSAKAMDNFAEFGVVFLLFIIGLELTFERLIAMRIHVFGFGSLQVIVTMVAIWCIALAFGVNTNMAAVIGGGLALSSTAIVLQVLQEKGSQASQVGRLSIAVLLMQDFAVVPLIVLVPLLTGNSENSLISSLTGSLLQAAIALVMIFITGRLLLRPLFSIIARMESNEVFISTTLLIILGAAFITEQFRLSMALGAFVAGLLVAETEHRHSVEHAVLPFKDLLLGLFFMTVGMSINIDLLLNKLPLITLLSIILIVLKTSIIYMLCRFFGFKRAPAIQAGLLLAQGGEFAFILFRLADELNVLPSEIAQVLMMVTTVTMAFTPLLSGLGDWIVNSFSTEKVILDDEAVETDTQDLYNHVIVAGFGRVGYMVTKMLTAEHLSYVVVDIQSKIVKEGKSDSFPIYLGDATRYEILKSVGIGRAQALVISIKNEVTIKKIVSLVATNFPHVNIIIRLPDLSNAEVYKDLGASKIIPETSEMGLQLGGAALSLSGISESGVASLKSKFRKGNYSMIKDISSDMDE

SEQ ID NO: 18332 - protein, 392 aa, Synechococcus elongatus PCC 6301
MKLSERVGRVSPSLTLAIAAQAKAMKAEGLDVCSFSAGEPDFETPLHIRNAAAQALAEGKTRYGPAAGEPDLREAIAQKLRADNGLDYQAANILVTNGGKQSLYNLMQVLLDPGDEVIIPAPYWLSYPEMVKLAGGVPVIVETFASDGFKLQPQQLAGAITPRTRLLVLNSPSNPTGMVYSRQELEAIAPIIEAHDFWVVSDEIYEKILYDGADHHSIGSLSPACFERTLISNGFAKAYSMTGWRVGYLAGPSELIAAAASLQSHSTSNVCTFAQYGAIAALQGPQDCVAEMLAAFTERRQLILNGLNQIAGLSCPIPEGAFYVFVDISKTGLDSMTYCRQLLDQHQVAAIPGIAFGDDRSIRLSYATDCQTIEKGLERLQLFQNSLLGVSV

SEQ ID NO: 18333 - protein, 114 aa, Synechococcus elongatus PCC 6301
MADFTEIDPQTFAERQAAQPAPDWQLIDVREPAEVELASLPGFRVYSLSRSAEWVDRIGQELDRSKETIVLCHHGMRSAQMCQWLLTQGFEHVVNLRGGIDAYSRLVDAQVPLY

SEQ ID NO: 18334 - protein, 238 aa, Arabidopsis thaliana
MSSQICRSASKAAKSLLSSAKNARFFSEGRAIGAAAAVSASGKIPLYASNFARSSGSGVASKSWITGLLALPAAAYMIQDQEVLAAEMERTFIAIKPDGVQRGLISEIISRFERKGFKLVGIKVIVPSKDFAQKHYHDLKERPFFNGLCDFLSSGPVIAMVWEGDGVIRYGRKLIGATDPQKSEPGTIRGDLAVTVGRNIIHGSDGPETAKDEISLWFKPQELVSYTSNSEKWLYGDN

SEQ ID NO: 18335 - protein, 274 aa, Mycobacterium avium subsp. paratuberculosis K-10
MTRRTIVITGASDGIGAAAARRLSRAGDRIVVVGRSQTKTAAVAAELGADHFVVDYADLSQVRALADKMRAQYPRIDVLLNNAGGVASRIELTADGYERTYQVNYLAPFLLTTQLLDVLLESRATVVNTTSSSHKLILRATVDDLENTANRRPAVAYAYSKLAIVLFTKELHRRYHARGLSVAAVHPGNVNSNIGIASGSRFLVFMQRYTPAALFISSPDQGADPLVRLASSPPDSEWTSGAYYAKRKIGKTTRLADDPRLAAELWERTAARLG

SEQ ID NO: 18336 - protein, 351 aa, Listeria monocytogenes str. 1/2a F6854
MYEACGGCQLQHVAYSAQLELKRDIVIQSIEKHTKIDPTKLKIRPTIGMEDPWRYRNKSQFQTRMVGSGQVETGLFGANSHQLVPIEDCIVQQPVTIKVTNFVRDLLEKYGVPIYDEKAGSGIVRTIVVRTGVKTGETQLVFITNSKKLPKKREMLAEIEAALPEVTSIMQNVNQAKSSLIFGDETFLLAGKESIEEKLMELEFDLSARAFFQLNPFQTERLYQEVEKALVLTGSETLVDAYCGVGTIGQAFAGKVKEVRGMDIIPESIEDAKRNAEKNGIENVYYEVGKAEDVLPKWVKEGFRPDAVIVDPPRSGCDQGLIKSLLDVEAKQLVYVSCNPSTLARDLALLA

SEQ ID NO: 18337 - protein, 699 aa, Carthamus tinctorius
MLMLIKQKMGTFFCPKMKITFLKLWRRMMRDVSSTSLMLMNQYDRSGDVFPTVEAAEKMYRKYASAAGFDVRLSNKKTNKFGITIARFFVCNKEGHPTPKLYDSLNKKSGERRRRNSNLKRAGCMACMKVHYVKSIGRYEVYKFNEKHSHMLFSGDEMSLSRSNRELTFGDQCNVFNACVTKVGVSKSHRLRNISKGNVGLSGGTVRDYQNFKKDMVTFVGNKDAKMLINTMVNRQKISPQFFFEFKCNEKELLAIFWADEVARMNYREFGDAISFDATYRTQKHAMIFVPFVAVDNHKKSVVVGAALIRKENADYFTWVLNAFVKAHGSLPKLVITDQCPAMKQAISIAFPNTIHRLCLWHITKNVKKQVSVHLVKKTSFVADWNKMIWNLHLGPAEFDNKWEEFLDLYGLTGVSWFNHMYEIRESWIPAFFKDTPMSGLMKTTSRSESINASSVYTRKVFFEVQKELIKAVWCCGWDEITRADGKHVYVVTHKNKSSEVITKYTVVQDKTSMTVDCSCNLFVRNGILCRHALKVLLNDGVDRIPDKYILRRWRRDLIPPQWLPARVRYGEVDVEKERLMARAFAAVDRMIGRVRNEKDVLERVVEKLENMDEELDEVVPLKSSRERKKEAIREFVGVPESDDNDVLPPSGIRNKGCGRGKRLKGVRERVDEEAKKPKRLCRTCNDFVRHDSRNCPMR

SEQ ID NO: 18338 - protein, 545 aa, Blastopirellula marina DSM 3645
MQPTTVEQVVLDLIVILTAGAISGAVCRRFQISSLVGYLMIGAICGSGGLGFFTSESEVLAHLAEIGALFLLFSIGMEISLDEVQEFAFRLLVGGPTQLLLVSIPSALLIRALGLDWPAAILLGSAIALSSTVLVFRALKEGGVQSTAAGVSSISVLIFQDMAIVPLMLMAPLLAGASDKSSMDLLKLGLYSLMFLAIIPISGAIVRRIGVPVLQRLRSRELLVLFALAVLGGMCYLAHELGLPAALGAFAAGLILSGNRLTQQVDALILPFRETFAAIFFISLGGLLHFQEAMQDPWLILIGLPVILALKTLGGAVALRAVGVRWPVAFCFGLGLAQVGELSFLLLSEGMRLDLINAAQYNQMLVLAIATLLLTPAMISYGIRAVGDHLAEVVRHVKKLKRPPSDVKEAVVIGVGPIAKQVASRFEMMGILVCFVDMNAVNTYPLEQMGFRTVTGDATKLKTLQQAEVDRAQLVLVSVPSDEAAVAIVRTIRRLNKKATIMARCRYLETRARLLSSGADLAIDEESHVASALLSMVDSLDLSPH

SEQ ID NO: 18339 - protein, 69 aa, Chlamydomonas sp. HS-5
MDESNATCGKRLDSIGVENTEENRRAYRDLLLSTPGLGQYISGAILFEETLYQCTKDGKTFVQVMNDQG

SEQ ID NO: 18340 - protein, 579 aa, Arabidopsis thaliana
MVEGRRRRRFSLSSQQLALLLLLLSFFLCFSVASPRAISDSDLLDETVANSSSSVASLNASSSSSLVKPKEGSFADIIDRALEKEFNESDQNEVADPGSFNNSVAGQQFEYLNVRLVVVPCGDQAVLETVARVKSTKKNETKEEKRFQLHDVFNLNNDNRAEDTPTLIDRKDNVFIISNSKSKLISDLVVVIVSATCGGIAFACAGQPVITGYLLAGSIIGPGGLNFISEMVQVETVAQFGVVFLLFALGLEFSTAKLKVVRSVAVLGGLLQILLFMFLCGITVSLCGGKRSEGVFVGAFLSMSSTAVVLKFLMEKNSTNSLHGQVTIGILILQDCAVGLLFALLPVLEGNSGIVHGMLSIGKLMVSLSSQTNELYQLAAVAFCLLVAWCSDKLGLSLELGSFAAGVMISTTDLAEHTLEQIEPIRNLFAALFLASIGMLVNVHFLWTHVDILLASVILVIIIKTTIVTTVVKGFGYNNKTALLVGISLAQIGEFAFVLLSRASNLHLIEGKLYLLLLGTTALSLVTTPLVFKMIPAVVHLGILLKWFSPDSTIEKGEIVRSESGKQRMILMSRQSHSS

SEQ ID NO: 18341 - protein, 156 aa, Photorhabdus luminescens subsp. laumondii TTO1
MLEKSLILIKPDAVHRGLVGKIITEFEEKGFKIHNIRSLVLNDEDFYFLYPKILGKPFHKQFKTVMQSAPSTLLVLSGHNALGSIFNFAGAYSNPEEDTTRSIRQKYSVWTGADVIHRAADSNEAMKQIAYFFDEVCEYRHNNEAFMAKEYWEPNV

SEQ ID NO: 18342 - protein, 358 aa, Magnaporthe grisea 70-15
MPPGVRCQNSFGGSGPAANDIDPFTRLRLLLVKGLENKIHVDQRLNPRLAGIGITVSQLGCVFESQGCITGRIGSDADNVQVNRYLARSETNQTIDDFDLRNGAHTPRTPGGRPSWTLYNHVGLYLHNKQLIMSGVWGWFGGNAAQRRKDTPKNAILGLRSQLDMLQKREKHLQNQISEQDAIARKNISTNKNAAKAALKRKKTHEHSLDQTLSQIGTLEQQINAIESANINMETLEAMKKAGKAMEDIHGKLTVEKVDETMDKLREQNALSEEIVNAITNNQLGNEAIDDADLEDELEAMEQEQLDEKILKTGTGPVSDAIQRLPAAANGELKGKATTVEEDDEEAELRKLQAEMAM

SEQ ID NO: 18343 - protein, 818 aa, Oryza sativa
  misc_feature (36)..(36): Xaa can be any naturally occurring amino acid
  misc_feature (521)..(521): Xaa can be any naturally occurring amino acid
  misc_feature (529)..(529): Xaa can be any naturally occurring amino acid
  misc_feature (534)..(534): Xaa can be any naturally occurring amino acid
  misc_feature (543)..(543): Xaa can be any naturally occurring amino acid
  unsure (1)..(818): unsure at all Xaa locations
MPEAAAAAAGHMDPVGDEAAERREMEEKEEEEEEEXEDEEFYESLDRILSSSCSSTSASDDDDQQHRRRRRHHPQPQQLSSSATFSAYEVWISEPTSVEERRRVLLRRLGLAHDSEPLPHPSPRVSSSSPRSPTPSPPSSSPPRPAPVVAAAEEPRSSGHGKPPLARNPSGGAEQCRIRNLDDGTEFEVGEVHDEVVREVGTGRQLTFEEFELCIGRSPIVQELMRRATTAASSSTSDHAAPASKPRRKPGGWLRGIRHLAGSVAYGRSSTDERDKEKEKEKKEREARRLSSATDDSLDGNGSRNAGRVRVRQYGKACKELTGLFMTQELAAHSGSIWCINFSLDGRYLASAGEDRVIHVWEVSEGERKGELLGEGTVARENGGGCSPFLAAVGNGSPELATLSLSCADGGFVEKKRRPRMQSSRKSVGSDHLVVPECVFGFRDKPVCSLLGHAADVLDLSWSKSQYLLSSSMDKTVKLWDITTSTCLKTFSHTDYVTCIQFNSRDDNFFISGSLDEKVRXWNVHDRKXGWNDXHEMVTAACXSPDGQVALVGSHKGSCHLFDTTEKKLQYKSQIELRIRKKKSGQKKITGFQFAPGSSSEVLITSADSRIRVVNGDELVHKFKGFRNTSSQISASVAPNGKYVVCASEDSHVYVWRHDNTSHPSRSRSAVDVTNSYEHFHCHDVTVAITWPGAESRGSFGSRSSRNSDSDDAVMNTGRDAPVENSEHDLNGTVNRCTKRPVCEGVASTSNPPADGVSTSWPDEKQSSAKSSPGHCSSDLCIGALDVQRRSAWGLVIVTAGRGGEIRVFQNFGFPVQV

SEQ ID NO: 18344 - protein, 331 aa, Photobacterium sp. SKA34
MTIKVGINGFGRIGRFVFRAAQERNDIEVVGINDLIDVEYMAYMLKYDSTHGRFNGTVEVEGGNLIVNGKTVRVTAERNPEDLKWDAINVDVVAEATGLFLTDETARKHITAGAKKVVLTGPSKDATPMIVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYETICAAMKEASEGALKGVLGYTEDQVVSQDFIGETQTSVFDAKAGIALTDNFVKVVSWYDNEIGYSNKVLDLIAHISK

SEQ ID NO: 18345 - protein, 490 aa, Silicibacter sp. TM1040
MLDATTDLKSLLADPTLLEDRAYINGAFVAGEGTFEVTNPARGDVIANVADVSRMQARDAIAAAQGAQKEWAKWTGKERAGVLRKWFDLMMAHQEDLAVILTAEMGKPLAEARGEIAYGASFIEFFAEEAKRVYGETIPGHQRDKRITVIKQPIGVAASITPWNFPNAMITRKAGPALAAGCAFVARPASETPLSATALAVLAERAGIPAGVFNVIPASDASGIGKEFCENPIVRKLTFTGSTNVGRILLRQAADQVMKCSMELGGNAPFIVFDDADLDAAVEGAIMCKFRNNGQTCVCANRIYVQSGIYDAFAAKLKEKVEAMKVGDGLEDGTHFGPLISEAAVKKVEDHIADAMDKGAEVILGGAPSELGGTFFEPTIVTGATPDMAFAQDETFGPLAPLFKFETEDEVIEMANDTIFGLASYFYAKDLSRVYKVAEALEYGIVGINTGIISTELAPFGGVKQSGLGREGSHHGIEDYLEMKYLCMSV

SEQ ID NO: 18346 - protein, 353 aa, Glycine max
  misc_feature (321)..(321): Xaa can be any naturally occurring amino acid
  unsure (1)..(353): unsure at all Xaa locations
MNAESPPGLLMSVSCLSDYDLLCGEDSSGILSGESPECSFSDIDSSPPPPSPTTEDCYSIASFIEHERNFVPGFEYLSRFQSRSLDANAREESVGWILKVHAYYGFQPLTAYLAVNYMDRFLDSRRLPETNGWPLQLVSVACLSLAAKMEEPLVPSLLDLQIEGAKYIFEPRTIRRMELLVLGVLDWRLRSVTPLCFLVFFACKADSTGTFTRFLISRATEIIVSNIQEASFLAYWPSCIAAAAILTAANEIPNWSVVKPEQAESWCQGIRKEKVIGCYQLMQELVINNNQRKLPTKVLPQLRVTTRTRMRSSTVSSFSSXSSSSSSTSFSLSCKRRKLNNRLWVDDEKGNSE

SEQ ID NO: 18347 - protein, 277 aa, Heliobacillus mobilis
MKKKITLPQFKVRKEQGKKFRMVTAYDYPFAQLVDESEVEVILVGDSLGMVVLGYDSTVPVTLEEMIHHCRPVVKGAPHTLVVADMPFGTYNISKEDAIRNANRMLKESGIEAVKLEGGKKVAPIVEAIVDAGIPVMGHIGLTPQTAAQLGGFKVQGKTEEAAQQLLEDALALEKAGAFSLVIECVPADVARRITEALSIPTIGIGAGPYCDGQVLVIQDMLGMFDRFTPKFVKKYANIGPTIKEALNTYAQEVSDGTFPGPEYSFGMDSNELKRLY

SEQ ID NO: 18348 - protein, 128 aa, Zea mays
  misc_feature (28)..(28): Xaa can be any naturally occurring amino acid
  unsure (1)..(128): unsure at all Xaa locations
GTATATPRKLAPVLRWGRSLARPLRLGXRPPGGGGQRILPDGGGKPPVTTPKGQVPVYVAGKGKGSQSFRYVVPVVYFNHPTFGKLLREAKEKFGFKHPGVIRIPCPPAGFKGAGALPPGAKKGFARW

SEQ ID NO: 18349 - protein, 366 aa, Arabidopsis thaliana
  misc_feature (140)..(140): Xaa can be any naturally occurring amino acid
  unsure (1)..(366): unsure at all Xaa locations
MSCFKSKFAGKSYFRRTFHSSIVQFHPQLSILIWHRRYSIIRTYELIANAAYIGTPGKGILAADESTGTIGKRFVSINVENVESNRRALRELLFTTRGALQYISGIILYEETLYQKTASGKLFVDVMKEAGVLPGIKVDXYEAGARFAKWRAVLKIGNNEPSELAIHENAYGLARYAVICQENRLVPIVEPEILVDGSHDIEKCAYVTERVLAACYKALSDHHVILEGTLLKPNMVTPGSDSGSKVKPEVIAKHTVRALQRTVPAAVPAVVFLSGGQSEEEATVNLNAINQLKGKKPWSLTFSYGRALQQSTLKAWGGKEENVDKAQKAFLARAKANSEATLGGYKGDAQLGEGASESLHVKDYKY

SEQ ID NO: 18350 - protein, 389 aa, Burkholderia xenovorans LB400
MRALRWHGKHDIRCDTVPDPIIEEGRDAIIKVSTCAICGSDLHLFDGFMPTMESGDIMGHEFMGEVVEVGKDNKALSVGDRVVIPFTIFCGECDQCKRGNFSVCERSNRNKEKADKVFGHATAGLFGYSHLTGGYAGGQAEYVRVPMADTTHVKIPDGLTDEQVLFLGDIFPTGWQAAVNCDIQPEDTVAIWGAGPVGQMAIRSAVLLGARQVVVIDRVPERLVMARAGGAITINFDEESVLDRLKELTNGKGPEKCIDAVGMESHATRSFDAMYDRVKQAVMLETDRPHVLREMIYVCRPAGILSVPGVYGGLIDKIPFGASMNKGLTWKMGQTHVNRWTDDLLHRIQEGQIDPSFVITHTVSLEQGPDMYKTFRDKEDGCIKVVMKP

SEQ ID NO: 18351 - protein, 481 aa, Haemophilus somnus 2336
MNIQHLLKTQAYINGEFISAKNHRTFPVINPANQQVICEITCCGKEETELAIKSAKQAQVHWKKYTAKERSKILKKWFELIMQHQESLAYLLSLEQGKPLSESRAEIAYGASFVEWFSEEAKRAYGEIIPQVREENRLLVIKQPVGVVAAITPWNFPNAMITRKAAPALAAGCAIIIKPAPETPLSALALAALAEQAGIPKGIFNVLPTVYAEEVGSVLTRSTDVRKLTFTGSTKIGKILMQQCADTVKKISLELGGNAPSLIFNDADLDRTVDSVIASKFRNSGQTCICTNRIYVQSEIYRAFADKLKQKVRSFIVGDFQQEAVNIGPLINESAVRKIERHIEDALSKGAILTLGGQRHSLGGTFFEPTILENVSQDMLVCHEETFSPLAALIPFDTEEQAISMANDSEFGLAAYVYTQDFSRIWRLSEELECGLVGVNEGIISNEVSPFGGVKQSGLGREGSRHGLDEFLEMKYLCMKV

SEQ ID NO: 18352 - protein, 999 aa, Malus x domestica
MLLFLPLLLLLLLPPLPTTLSLNQEGLYLRHFKLSLDDPDSALSSWNYADSTPCNWLGVTCDDASSSSPVVRSLDLPSANLAGPFPTVLCRLPNLTHLSLYNNSINSTLPPSLSTCQTLEDLDLAQNLLTGALPATLPDLPNLKYLDLSGNNFSGAIPDSFGRFQKLEVLSLVYNLIENTIPPFLGNISTLKMLNLSYNPFHPGRIPAELGNLTNLEVLRLTECNLVGEIPDSLGRLKNLKDLDLAINGLTGRIPPSLSELTSVVQIELYNNSLTGELPPGMSKLTRLRLLDASMNQLSGQIPDELCRLPLESLNLYENNLEGSVPASIANSPNLYEVRLFRNKLSGELPQNLGKNSPLKWFDVSSNQFTGTIPASLCEKGQMEEILMLHNEFSGEIPARLGECQSLARVRLGHNRLSGEVPVGFWGLPRVYLMELAENELSGPIAKSIARATNLSLLILAKNKFSGPIPEEIGWVENLMEFSGGDNKFSGPLPESIVRLGQLGTLDLHSNEVSGELPVGIQSWTNLNELNLASNQLSGKIPDGIGNLSVLNYLDLSGNRFSGKIPFGLQNMKLNVFNLSYNQLSGELPPLFAKEIYRNSFLGNPGLCGDLDGLCDSRAEVKSQGYIWLLRCMFILSGLVFVVGVVWFYLKYKNFKKVNRTIDKSKWTLMSFHKLGFSEYEILDCLDEDNVIGSGASGKVYKVVLNSGEVVAVKKLWRRKVKECEVEDVEKGWVQDDGFEAEVDTLGKIRHKNIVKLWCCCTARDCKLLVYEYMQNGSLGDLLHSSKGGLLDWPTRFKIALDAAEGLSYLHHDCVPAIVHRDVKSNNILLDGDFGARVADFGVAKEVDATGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQAAKKEGKLTPYYYEDTSDHGSVA

SEQ ID NO: 18353 - protein, 257 aa, Sinorhizobium meliloti
MLLTGGRSGGRSSPEDFRHVALAETVSTNSECLLRAREGDPGNLWITAVRQTGGRGRRGRAWFSEPGNLYASLLLIDPAPVDRLHALPLAAAVAVHRAIRRVMPPGGAEAAIKWPNDILIDGRKTCGILLEGEVLADGRRALVIGCGINVAVMPEDALYPVTSLRREGATISPEELFAHLFVTMAETLAVWDRGAGVAAIIDQWRAAAKGIGEAITVNLPDRSLSGRFAGIDRDGRLLLDTGSGPPQTIAAGDVFFG

SEQ ID NO: 18354 - protein, 338 aa, Burkholderia xenovorans LB400
MALQRRTTLTKYLIEQQRETNNLPADLRLLIEVVARACKAISYHVSKGALGDALGTAGSENVQGEVQKKLDILSNEILLEANEWGGNLAGMASEEMEQFFPIPANYPKGEYLLVFDPLDGSSNIDVNVSIGTIFSVLRCPDGQQPTEQSFLQPGTQQVAAGYAVYGPQTVLVLTTGNGVNCFTLDRELGSWVLTQSDMRIPVETREYAINASNERHWYPPVQQYIGELKDGKEGSRQSDFNMRWIASMVADVHRILNRGGIFMYPADKRTPDKPGKLRLMYEANPMAFIVEQAGGAATNGEKRILDIQPKSLHERVAVFLGSKNEVDRVTRYHLETKK

SEQ ID NO: 18355 - protein, 518 aa, Cryptococcus neoformans var. neoformans JEC21
MNDQTLPPFLRVNPSPVPPPSHARLQALYASTSAQRTANPTGYAANAQWWAGVLEETLRTGWLNGEGGDRLVLKVDNGVLGRLEDEKGSRPRGLGGVVETLATTTPPTLHALTHFMTSATPLHVPASLTSRFVGRPLWWAFSQLNPFGGSEKVVKEEALWAKYGQGKEYVHMPLLEQSAAAFTAHMLKSPILSYTSSLYDLDTFLAEYGEACFPTGPTAKELPKGKHGLSKRDAEVLVKWLSRDCQLVVTDGSVIKVLDADQIAENHPISEADRGAVSVLNALRRVEKQIVGIEEQISQSHEKAKKYLASKQKNIALSYLRSKKHLEDLLAKRVASSEQLRAVIRSIDQAKGDVEIMAAYETSTSTLTQVLAHPLLSPERIAATTDALAEAMADQEEIDQAVRIGGEVAMGGKRVEIDEDELAKELEALVEEEKEAEQEKTEKKTPVEAEKKPDMTTELPRTPLSAPASGKEEKEEGPVADEERLWQQRYEEAQARKQAEKERFETERLRKEEKIVAE

SEQ ID NO: 18356 - protein, 759 aa, Ustilago maydis 521
MPTRTNNRGIPVPRDQARGSVRGDNQQQAAWRSSLDLVWSYSRSQAFYGNNIATSPSFVERRWAGQDLEERDSIFEDEQEYVSGQDDEDESEDYDAHTSHSRFATDADADTDTASMASDARFGPSDQFEWEGEALPPNATQRIRTSRRSKARDRRLEQLESADEDERSRSRSRSPKRLAPGGPHERTSNSKLNPNRSAYSSATTGEMLRDPFAEDNINNNIKPSEVTPLLSNKRSTDANPARRKSATYGALQRPSDSATLSNRSADSGYHVYELGNSTLLQSWFNTVNALVGVGILALPLAFSYAGWIGGTILFLVCGLLTNYTGKVLAKIMSKEPSLRTYADIGSYAFGPSARILISLFFCLELWAVSVALIILFGDSMSAIFPNIAPAAFKLLGYCLVLPSVFLPLKFLSPISVIGIVSTFTLVVVVISDGLIKKHAPGSLWSIAPTTLGPRWDRLPLSFGLIMSGFSSHPIIPSLVRDMKDPAKFPRMLNLAYVGATVLYLSMGMVGYAMFGTQVSDEITKDLARTPGFPVALNSVAIWLIVINPLSKFALATRPIQTTFEILLGIDDQTAVRLQNRNVKARRRSSAAALAATSANVATDGSKIRMDDAAAAANKVVGPVQSRAQAQLTSEANSTTLSVSPNHRVSFATPGAPSSTVPQPEHQPPTSPTTHAAPANDNPLANSAISLRAAELTSTLSPRTRFILSILLKILLTLLIAVTAVVLPGFEKVMGVPRSIPGFCNMCLWSSVGQLEAFRQ

SEQ ID NO: 18357 - protein, 663 aa, Haloarcula marismortui ATCC 43049
MHHPGPPRFVATGDEVELAPRDPDPSATYTWRLTQAPKESTVSLGDDPVEHLVPDAPGRYVIRLTAPDGEHDLTVRAFPGRLQPSGTHTSGRSGGHSGVSSGRSGSGHSGSGEYTSARDSGDEDGGGGQPRLTLRPEIEGDEAVVRADCSPHPEGTETAGDLTVEFLLDDRDDIDADAVTRDGTALRIPLDALPDRARIHAVAIGDHGYSVPDAVEFSRDGGGIETVTSGDGVAASRPYDAPAWAEDAVIYEIYVRTFAGESDASPFDAIIDRLDYLDSLGVDAIWLTPVLQNDHAPHGYNITDFFEIASDLGTRADYERFIEAAHDRGFKVLFDLVCNHSARTHPYFESAVEGPDADYREWYEWRSDTEPETYFEWEHIANFNFDHLPVRRHLLDAVAQWAELVDGFRCDMAWAVPNGFWREIHDYCKDRDSEFLLLDETIPYIPDFQAGLFDMHFDSTTYAALRQVGDGGDAEAVLSAIEGRAEIGFPEHASFMLYAENHDETRYIVDYGRDAAEAAAGALFTLPGAPLLYAGQEFGQRGRRDDLAWDHADKALQSFVSDLSATRHDQPALSADADLVRIPYEVRDGPSDRVVAYARATDEDAAVVVLNFGSEPTTVRLPAGTDDTDLVSGEHRGAAGDGGATVTVDSVSVFPADESDLSQ

SEQ ID NO: 18358 - protein, 302 aa, Glycine max
MCAHVRQTLADLSSQEVADATRIQYGGSVKPNNIKEYMAQSDIDGALVGGASLKVEDFVQLLEDGFANRESEHGNAVKQAHKPNFDRYYEKYPTTQIEASGLDVGLPEGQMGNSEVGHMNIGAGRIVYQSLTRINKSIEDGEFFDNTVLNNAVKHVKDNGSALHVFGLLSDGGVHSHYKHLFAILELAKKQGIDKVYVHAFLDGRDVDQKSALKYIEETEDKFKELGVGQFASVSGRYYAMDRDKRWDREERAYNAIRNFEGPTFTSAKAGVEANYKNDVTDEFVEPFIVEGQNDGVNDGDA

SEQ ID NO: 18359 - protein, 333 aa, Oryza sativa
MSAYCGKYKDELIKNAAYIGTPGKGILAADESTGTIGKRFASINVENVEENRRSLRELLFCTPGALQYLSGVILFEETLYQKTKDGKPFVDVLKEGGVLPGIKVDKGTIEVAGTEKETTTQGHDDLGKRCAKYYEAGARFAKWRAVLKIGPNEPSQLAIDLNAQGLARYAIICQENGLVPIVEPEILVDGPHDIDRCAYVSEVVLAACYKALNEHHVLLEGTLLKPNMVTPGSDAKKVSPEVIAEYTVRTLQRTVPAAVPAIVFLSGGQSEEEATLNLNAMNKLSTKKPWSLSFSFGRALQQSTLREPSRQGLQVLICLGRCWLPLEHSAAVA

SEQ ID NO: 18360 - protein, 589 aa, Saccharomyces cerevisiae
MTISSAHPETEPKWWKEATFYQIYPASFKDSNDDGWGDMKGIASKLEYIKELGADAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWKSYFGGSAWTFDEKTQEFYLRLFCSTQPDLNWENEDCRKAIYESAVGYWLDHGVDGFRIDVGSLYSKVVGLPDAPVVDKNSTWQSSDPYTLNGPRIHEFHQEMNQFIRNRVKDGREIMTVGEMQHASDETKRLYTSASRHELSELFNFSHTDVGTSPLFRYNLVPFELKDWKIALAELFRYINGTDCWSTIYLENHDQPRSITRFGDDSPKNRVISGKLLSVLLSALTGTLYVYQGQELGQINFKNWPVEKYEDVEIRNNYNAIKEEHGENSDEMKKFLEAIALISRDHARTPMQWSREEPNAGFSGPSAKPWFYLNDSFREGINVEDEIKDPNSVLNFWKEALKFRKAHKDITVYGYDFEFIDLDNKKLFSFTKKYNNKTLFAALNFSSDATDFKIPNDDSSFKLEFGNYPKKEVDASSRTLKPWEGRIYISE

SEQ ID NO: 18361 - protein, 229 aa, Triticum aestivum
QPALYSKELLEQRAAGPAMMHPSEAVAKGPRWADLFEPGVKHALFVGIGIQILQQFAGINGVLYYTPQILEQAGVGVLLSNIGLSASSASILISALTTLLMLPSIGIAMRLMDMSGRRFLLLATIPILIVALAILVVVNIVDVGTMVHAALSTISVIVYFCFFVMGFGPIPNILCAEIFPTTVRGICIAICALTFWIGDIIVTYTLPVMLNAIGLAGVFGIYAVVCILA

SEQ ID NO: 18362 - protein, 388 aa, Nostoc punctiforme PCC 73102
MKLAARVSQVTPSLTLAIAAKAKALKAEGIDVCSFSAGEPDFDTPAHIKAAAVKALDEGKTKYGAAAGEPKLREAIAHKLKNDNGLDYKSENVIVTNGGKHSLYNLIVALIDLGDEVIIPAPYWLSYPEMVTLVGGVAVIVPTDATTGYKITPEQLRKAITPKTKLFILNSPSNPTGMVYTPDEIKALAQVVVDADIFVVSDEIYEKILYDGAEHISIGSLGKEIFDRTLISNGFAKAYSMTGWRIGYLAGPVEIIKAASTIQGHSTSNVCTFAQYGAIAALQSSQDCVEEMRQAFAKRRQVMLDRLNAIPGLSTAKPDGAFYLFPDISKTGLKSLEFCDALLEKHQVAVIPGIAFGADDNIRLSYATDMATIEKGMDRLEKFVKSRI

SEQ ID NO: 18363 - protein, 470 aa, Geobacillus kaustophilus HTA426
MQPVQELKRELKSRHLFMIALGGVIGTGLFLGSGYTIHEAGPGGAVVAYLFGGLVMYLTMLSLGELAVRIPDAGSYQTYATKFISPAVGYCIGWLSWLNWSVTVGIELLTVSILMKRWFPDVPTWVFCAVFALLLFLINALSVKGFGEVEFWFSSIKVLTVIAFIVLGLAAMFGVIHMKNGQPAPFFSNFTDHGGLFPNGFWAIFTTMILVNFSFQGTELVGVAAGESREPEKTVPVALRNTVWRILIFFILAIFVLAGLFPWEKAGVVESPFVEVFDNIGIPYAADIMNFVIITAVLSVANSGLYATSRVLWSMSRQGMVTPFFSKLSKRGVPINALIASIAIGCLSLLCSVYAEDTVYVWLTAIAGFGAVTVWASIALSSYFGRKAFLREGGDVRDLKYRTPLYPFVPLAAFALNMATIIGLAFIPDQRIALYCGIPFLLACYGYYHLVAKKRVQPLAAEEGELKAAK

SEQ ID NO: 18364 - protein, 445 aa, Thermoplasma volcanium GSS1
MPEDVVEKTLKKLDQDKVEFLQMQFTDIVGNVKSLTVPKNRFENALTEGVVFDGSSVAGYAQIEESDMRAIPNLDSYTLLPDEFGKSRVVRFVCNVYSPDGSRFPGDPRYVLEKLLEKVHKEGNEFFVGPEFEFFLFKRDANGNPTTEPSDYGGYFDNTPLDSASDIRQQIVRELYELGYQPEAAHHEVAYGQQEIDLRYAPALKMADRIVMLKSIIKNVAERNGLYASFMPKPINGVNGSGMHIHQSIMSFDEKVNRFYDKNAKYGLSDYAMHYLGGILSHINEGSAILASTVNSYKRLIPGYEAPVYISWANKNRSALIRIPAGEGTRKRMELRCPDPAGNPYLQFAVILGMGLDGIEKKIDPPEPIEKDIFHMTKEERLQEGITSMPESLGEALHHLRNSKLMRDILGDHVYENFLTVKQREWDQFRSYVGEWEIKKYLPTL

SEQ ID NO: 18365 - protein, 481 aa, Chlamydophila abortus S26/3
MIARTKIICTIGPATNTPEMLEKLLDAGMNVARLNFSHGTHESHGQTISLLKELREKKGAPLAIMLDTKGPEIRLGKIPTPIQVSRGQKITLLEKEIEGSLEGGVTLHPQCVFPFVREGTDVLIDDGYLQAVVTSAGNDWLELEFINSGELKSHKSLSIREIDLALPFMTDKDIHDLKFGVDQGVDVIAASFVRCAEDIESMRKCLADCGRGDMPIIAKIENRLGVENFPQIAKVADGIMIARGDLGIELSVVELPSLQKFMAKISRETGRFCITATQMLESMIRNVLPTRAEVSDIANAIYDGTSAVMLSGETASGSHPIAAVKIMRSVIQETEKNLNYMSFLEINDSESAVKVSPYLQSIGLSGIQIAEKAAAKAIIVYTESGGSPIFLSKYRPRFPIIAVTPNLSVYYRLALEWGVYPMLTEESDRTVWRHQACVYGIERGILSNYDKVLVLSRGAQMKDTNNLTLTTVNDIISASAK

SEQ ID NO: 18366 - protein, 313 aa, Medicago truncatula
MAKPPSSPPLTTIGTLIYYLSEHPSIISFRWSHSHSWGSTWSFLITSIATYLILSLFLHLSLSLLFPNRRHIPLGPIPALHSLTMSLISATIFTGTLISAVSEIRDTQWFWHRSKTPLRWLLCFPLGTRPSGRVFFWSYVYYLSRFLHMLRTILTILHRRRLSFYQLVNHSVSTLVSFLWLEFSQSFQVLAILFATLVYSLVYGYRFWTAIGLRSACFPFVLNCQILLLGCNVACHVGVFLLHFFFEVGGCNGMGAWVFNSILNTAVLVIFIHFYVRMYFVGKSERRMVQETESMDCSSSCPDLIVGSRARSR

SEQ ID NO: 18367 - protein, 251 aa, Heliobacillus mobilis
MRKTIIAGNWKMHKTIAEAVTLAEAIKSQNPNPTVEIVICPPFTALAEVAKAVQGSPVAVAAQNMHWEVQGAFTGEVSPAMVKDAGCKYVVLGHSERRQYFGETDETVNKKVKAAIAHELIPIVCVGETLEQREAGQTEDVVATQTKGGLAGLSAQEVADLVIAYEPVWAIGTGRTASDDDAQQVNAYIRSVVAEVFGKEAAEAVRIQYGGSVKPSNAENLLAKGDIDGALVGGASLKIEDFQGIIDGAKA

SEQ ID NO: 18368 - protein, 377 aa, Methanocaldococcus jannaschii
MFINGDVMLSKRLLNFESFEVMDILALAQKLESEGKKVIHLEIGEPDFNTPKPIVDEGIKSLKEGKTHYTDSRGILELREKISELYKDKYKADIIPDNIIITGGSSLGLFFALSSIIDDGDEVLIQNPCYPCYKNFIRFLGAKPVFCDFTVESLEEALSDKTKAIIINSPSNPLGEVIDREIYEFAYENIPYIISDEIYNGLVYEGKCYSAIEFDENLEKTILINGFSKLYAMTGWRIGYVISNDEIIEAILKLQQNLFISAPTISQYAALKAFEKETEREINSMIKEFDRRRRLVLKYVKDFGWEVNNPIGAYYVFPNIGEDGREFAYKLLKEKFVALTPGIGFGSKGKNYIRISYANSYENIKEGLERIKEFLNK

SEQ ID NO: 18369 - protein, 337 aa, Daucus carota
MAPIKIGINGFGRIGRLVARVALQRDDVELVAVNDPFISTDYMTYMFKYDSVHGAWKHHELKVKDEKTLLFGEKPVAVFGCRNPEEIPWASTGAEYIVESTGVFTDKDKAAAHLKGGAKKVIISAPSKDAPMFVVGVNEKEYKSDLHIVSNASCTTNCLAPLAKVINDRFGIVEGLMTTVHSITATQKTVDGPSAKDWRGGRAASFNIIPSSTGAAKAVGKVLPQLNGKLTGMSFRVPTVDVSVVDLTVRLEKKATYDQIKAAIKEESEGKLKGILGYTEDDVVSTDFVGDSRSSIFDAKAGIALNDNFVKLVSWYDNEWGYSTRVVDLIVHMASVQ

SEQ ID NO: 18370 - protein, 310 aa, Candida glabrata CBS 138
MAALHKNTSTLKLNTGAHIPVIGLGTWQSSENEGYNATLEALKAGYRHIDTAAIYKNEEEIGRAIRDSNIPRNELFVTTKLWGTQHRNPTEALDQSLKRLGLDYVDLYLMHWPVALKTDLIKDGNLLQIPEREDGSRDVDLEDWNFVKTWELMQELPKEKARAIGVSNFSINNLKELLNSKGNKVVPAANQIEIHPLLPQDELINFCKEKGIVLEAYSPLGSTDAPILKEEEITEIAKKNGVNAGQLVISWHAQRGYVVLPKSVKPERIHGNQETFKLSDEDFATLSNYAKKHGERRVVSPNWGPFKPFV

SEQ ID NO: 18371 - protein, 326 aa, Candida glabrata CBS 138
MSSVVTLNNGLKMPLVGLGCWKIPNDVCAQQVYDAIKIGYRLFDGAEDYGNEKEVGQGIRKAIDEGVVKREDVFVVSKLWNSFHHPDHVKMALKRTLSDMGLDYLDLFYIHFPIAFKYVPFEEKYPPGFYTGKEDEKNGHITEAHVPIIDTYRALEQCVEEGLIKSIGISNFSGSLVQDLLRQCKIKPVALQVEHHPYLTQEHLVEYCKDNGIQVVAYSSFGPQSYIELNHPLAKNTPNLFHHDTIKQIANNHNVATSQVLLRWATQRGIAIIPKSSKKERLQDNLMIDEKLTLTHKELEAISKLNKNLRLNDPWDWLDGKFPIFA

SEQ ID NO: 18372 - protein, 233 aa, Magnaporthe grisea 70-15
MPSTDSIPKSNFDAIPDVIQAFKNGEFVVVLDDPSRENEADLIIAAESVTTEQMAFMVRHSSGLICAPLTPERTTALDLPQMVTHNADPRGTAYTVSVDAEHPSTTTGISAHDRALACRMLAAPDAQPSHFRRPGHVFPLRAVAGGVRARRGHTEAGVELCRLAGKRPVAVISEIVDDGQEVEGRAVRAAPGMLRGDECVAFARRWGLKVCTIEDMIAHVEKTEGKLETNGSG

SEQ ID NO: 18373 - protein, 343 aa, Candida glabrata CBS 138
MPAPTQPAPSYSKCYALKEIIYGFWATKVTYTPDKYPDLTGKTAVVTGCNTGVGKEAAKLLYQKNCNVIGVCRTESKGLEAAESIKQEIGNSKGSISVVSGCDFLDFTTVPQAGKRIQEILAGKPLNIIIHNAGLMSSSNAGTSKQGLEAMFQTNVMGPQLLQHYLDPVFLKEDDTSLKRIVWVSSGAHLLGPSQYGIFWENPGFDGVAIEKRPAATTLYGATKAANILQAKAWATRNKEMVDKIGCVSVSCYPGNLRTDLQRDWHPWTRATVGRLFYPAEYGAYTELYSVLSPSLTTSDQGKYICPFDQVHEPREDVKEGLQNGTDLALWDWIESEIKEYIS

SEQ ID NO: 18374 - protein, 201 aa, Xanthomonas oryzae pv. oryzae KACC10331
MGDEVHLTVDEVTYQAHGHAHLGSASGFLAALAEGDIAPVYIEPNARFRVPADADRDILMIGPGTGVAPFRGFVQERAETGANGRNWLFFGAQHFNTDFLYQAEWQLALQRGELHALEVAFSRDQAEKLYVQHRLRARGAEVYAWLQGGAHVYVCGATSMGKDVHAALLDIVASHGALDAEAASAYLTQLQVEGRYARDVY

SEQ ID NO: 18375 - protein, 472 aa, Salmonella typhimurium LT2
MVSINHDSALTPRSLRDTRRMNMFVSVSAAVAGLLFGLDIGVIAGALPFITDHFVLTSRLQEWVVSSMMLGAAIGALFNGWLSFRLGRKYSLMAGAILFVLGSLGSAFASSVEVLIGARVILGVAVGIASYTAPLYLSEMASENVRGKMISMYQLMVTLGIVLAFLSDTAFSYSGNWRAMLGVLALPAVLLIILVVFLPNSPRWLAQKGRHIEAEEVLRMLRDTSEKARDELNEIRESLKLKQGGWALFKANRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFIGITFWLIPETKNVTLEHIERKLMAGEKLRNIGV

SEQ ID NO: 18376 - protein, 386 aa, Medicago sativa
MAIHHHHHNHQQLQQHTSSLFDALYCDEEEKWEDDDEGEVVDEGAQSDVTTTNYDILDSTSLLPLLLLEQNLFNEDEELNTLFSKEITQQETYYEDLKNVINFDSLSQPRREAVEWMLKVNAHYGFSALTATLAVNYLDRFLLSFHFQKEKPWMIQLVAVTCISLAAKVEETQVPLLLDLQVQDTKYVFEAKTIQRMELLILSTLKWKMHPVTTHSFLDHIIRRLGLKTNLHWEFLRRCENLLLSVLLDSRFVGCVPSVLATATMLHVIDQIEQSDDNGVDYKNQLLNVLKISKEKVDECYNAILHLTNANNYGHKRKYEEIPGSPSGVIDAVFSSDGSNDSWTVGASSYSTSEPVFKKTKNQGQNMNLSPINRVIVGILATATSP

SEQ ID NO: 18377 - protein, 489 aa, Haloarcula marismortui ATCC 43049
MSQPDSQTAWDRLYIDGEWRDAGTSETIPVTNPATGDEIAAVPAGTEGDVNDAYQAAEAAQSDWAALSREERNEYVQAMIGVMQERLDEIVELLATESGSVQAKATAEANFAMADFQSALEMVPPEEEVRDSMYHEDKDHHIVREPAGVVGIISPWNFPLHLTTRALGPALALGNTVVIKPATDTPITGGLLLADIAEEAGLPDGVVNVVTGHGSDIGDRMAGHPTARVMSFTGSTAVGRSVASQAGDALALPALELGGNGPFVVTEDADIEAAAKAGSVGAFGHQGQVCISINRHLVHEDVYDEYVEKLVEHAESLTIGNPLDEDVEFGPIINESQVEQLTSFIEQTVDAGATLETGGEVEDLFLEPTVLSECTNDMSAACNEHFGPVAPVIPFESDEEAVELANDTEYGLAAGVYSSDVEHGRSIADQIDAGMVHVNDHPIQDEPNAPFGGMKNSGLGRYNGEWIMDELTETKWISVQHEERDYQLL

SEQ ID NO: 18378 - protein, 469 aa, Yersinia pestis biovar Medievalis str. 91001
MSAEHVLTMLNEHEVKFVDLRFTDTKGKEQHITIPAHQVNADFFEEGKMFDGSSIGGWKGINESDMVLMPDASTAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHHHEVATAGQNEVATRFNTMTKKADEIQIYKYVVHNVAHAFGKTATFMPKPMFGDNGSGMHCHMSLSKNGNNLFAGDKYGGLSEIALFYIGGIIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEAMAALNEDREFLTRGGVFTDDAIDAYIELRREEMDRVRMTPHPVEFELYYSV

SEQ ID NO: 18379 - protein, 310 aa, Synechococcus elongatus PCC 6301
MPMSPLWLLLVLPVSLLAIYLLTPRRYQSSDSVAQAYDSWTQDGILEFYWGEHIHLGHYGNPLRRKDFRAAKADFVHEMVRWGNLDRLPAGTTVLDVGCGIGGSSRILARDYHFDVTGITISPGQVQRARSLTPDGVTAQFKVDDALNLSFPDASFDVVWCIEAGPHMPDKALFAKELLRVLKPGGTLVVADWNQRDTRRRSLQGWERWVMRQLLDQWAHPEFASIEGFSELLEATGWVDGAVTTADWTRETLPSWLDSIWQGILRPAGLVRFGFSGLIKSLREVPTLILMRIAFGQGLCRFGMFRATRA

SEQ ID NO: 18380 - protein, 466 aa, Glycine max
MAVSAITGARLTLGMSLSSSTRSRTVAMAVSIDPKTDNKLTLTKSEEAFAAAKELMPGGVNSPVRAFKSVGGQPIVIDSVKGSRMWDIDGNEYIDYVGSWGPAIIGHADDQVLAALGETMKKGTSFGAPCLLENTLAELVIDAVPSIEMVRFVNSGTEACMGALRLARAYTGREKIIKFEGCYHGHADPFLVKAGSGVATLGLPDSPGVPKAATFETLTAPYNDTDAVEKLFEANKGEIAAVFLEPVVGNAGFIVPKPDFHNFLRKITKENNTLLVFDEVMTGFRLSYGGAQEYFGITPDITTLGKIIGGGLPVGAYGGRRDIMEKVAPAGPMYQAGTLSGNPLAMTAGIQTLQRIKEPGTYEYLDKITGELVQGIIEAGKRAGHAICGGHIRGMFGFFFTEGPVYNFADAKKSDTAKFARFFWGMLAEGVYLAPSQFEAGFTSLAHTSDDIKKTIAAAEKVFREI

SEQ ID NO: 18381 - protein, 419 aa, Mycobacterium sp. KMS
MPNCSARPASSFAASRHKCSSLDLMSGAHAQRTEPRDVALRAGIPPFYVMDVWLAAAERQRTHGDLVNLSAGQPSAGAPTAVREAAIAALQENQLGYTVALGIPELREAIAARYADQFGLTVGLDDVVLTTGSSGGFLLAFLACFDVGDRVAIASPGYPCYRNILTALGCEVVEIPCGADTRFQPTAAMLAELDPPVQGVIVASPANPTGTVIAPAELAAIATWCEATGTRLISDEVYHGLVYDGAPPISCAWQTSRKAVVVNSFSKYYAMTGWRLGWLLVPQELRRAVDRLTGNFTICPPALAQHAAVAAFTPESTAEADGLLAHYAENRRLLLDGLRAIGISRLAPADGAFYVYADVSHLTDASLSFCAKLLADTGVAIAPGIDFDTVHGNSFVRLSFAGPTADITEALSRIGGWLR

SEQ ID NO: 18382 - protein, 556 aa, Oenococcus oeni PSU-1
MSKKQWFKDTVVYQVYPMSFQDSDNDGIGDLPGITKRLDYIKKLGADVIWLNPIYESPNKDNGYDIANYRAINPEYGSMNDFDDLLNKAHQLNLKIMMDLVVNHTSDQHHWFQESKKTKDNPFSDFYIWRDPVDGHEPNNWLAAFGGSAWTYVPERKQYYLHLFATGQPDLNWENPDVRQAVFDIERFWLDKGVDGFRMDVINLISKPKGLPDVPEPATAGKTMDFVADGHRLNEFLSQMNSEVLSKYDTITVGEMPGSTTEDAIKYTGLNSHELNMVFQFEHVGLSPNPDVRLGKWNDQPVKLTELKASLNRWQTGLDGKGWNSLYWNNHDQPRAVSRFGNDDPKYRVLSAKMLATTLHLMQGTPYVYQGEELGMTNAHFTKLNQYEDIESINFYHELVEQEKIVDGPTMLKYLANISRDNARTPMQWNDKNNAGFSSAKPWFALNPNYKSINVEDSLADKNSVFYYYQKLIKLRHNNEIIKYGSFEEIDPDDDQVYAYRRHYEGKTLLLISNFTDKIVSRDYGQSNASSLLIDNYEDDKVNELRPYEAKAYLFK

SEQ ID NO: 18383 - protein, 412 aa, Escherichia coli K12
MKALTYHGPHHVQVENVPDPGVEQADDIILRITATAICGSDLHLYRGKIPQVKHGDIFGHEFMGEVVETGKDVKNLQKGDRVVIPFVIACGDCFFCRLQQYAACENTNAGKGAALNKKQIPAPAALFGYSHLYGGVPGGQAEYVRVPKGNVGPFKVPPLLSDDKALFLSDILPTAWQAAKNAQIQQGSSVAVYGAGPVGLLTIACARLLGAEQIFVVDHHPYRLHFAADRYGAIPINFDEDSDPAQSIIEQTAGHRGVDAVIDAVGFEAKGSTTETVLTNLKLEGSSGKALRQCIAAVRRGGIVSVPGVYAGFIHGFLFGDAFDKGLSFKMGQTHVHAWLGELLPLIEKGLLKPEEIVTHYMPFEEAARGYEIFEKREEECRKVILVPGAQSAEAAQKAVSGLVNAMPGGTI

SEQ ID NO: 18384 - protein, 331 aa, Haloarcula marismortui ATCC 43049
MERPIVALVLAGGTGTRLYPASRSDRPKQFLSFGEDESLLAETVSRVGFADETYVLTRDSFADGVREHVPNVAVLTEPEPKDTGPALAYAAHRIREQVGDCVLLCLPSDHRISGPFETVARTATRVAVETEGLVTVGIEPDRPATGYGYIKPGPSENGFAPVETFHEKPDRETATEYVREGFYWNAGLFAWAPTALLSAAASSPLAPMVERLDDGDHDDAFAAVDPVSIDYAVLEDAENAFVVPAALDWDDLGSWDAFERVLDGQDGNAVLGEAVSIDADGNVLASDGHISAVGVEDLVVASFDDRTLVVPKEEAQRVREVVGELRDDGRF

SEQ ID NO: 18385 - protein, 303 aa, Gibberella zeae PH-1
MADQHEVDLDSIIDRLLEVRGSRPGKQVQLLEAEIRYLCTKAREIFISQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFTMHGGLSPDLNSMEQIRRVMRPTDIPDCGLLCDLLWSDPDKDITGWSENDRGVSFTFGPDVVSRFLQKHDMDLICRAHQVVEDGYEFFSKRQLVTLFSAPNYCGEFDNAGAMMSVDESLLMAAKTRQSIPSPR

SEQ ID NO: 18386 - protein, 459 aa, Staphylococcus aureus subsp. aureus MRSA252
MENNELQRGLSARQIQMIALGGTIGVGLFMGATSTIKWTGPSVILAYLIAGIFLFLIMRAMGEMIYLNPTTGSFATFASDYIHPAAGYMTAWSNIFQWIVVGMSEVIAVGEYMKFWFPELPTWIPGVIAILLLMAANLFSVKAFGEFEFWFALIKVVTIILMIIAGFGLIFFGFGNGGHAVGISNLWTNGGFMPNGIVGFFFALSIVIGSYQGVELIGITAGETKDPQKNIVKAVNGVIWRILIFYLGAIFVIVSVYPWNQLGDIGSPFVATFAKIGITFAAGLINFVVLTAAMSGCNSGIFSASRMIYTLAHKGEMPKIFTKIMRNGVPLYTVVAVSLGILIGALLNVILPLYIDGAKSIFVYVYSASILPGMIPWFMILFSHLRFRKLHPEEVEGHPFKMPGGAVSNYLTILFLILVLVGMVFNVETRISVLIGVIFLTIVTIYYFIRYNKNNVKAK

SEQ ID NO: 18387 - protein, 377 aa, Thermoplasma acidophilum
MQYINESATVSASNNVEKLRKQGLKIYNFGIGEPDFTTPEGIIDYAFEMAKQGKTHYTPSAGIMELREKIASKLKTRNRIDANAENVLVTPTKFGINLAMMVILNPGDEVIIPDPYYVSYPDIVKLAGGKPVPVRTTDDYDIDLDEMRKFVTPRTRAIILNNPNNPTGKVLSEKEIRDLVDFALENDIYIVSDEIYEDLIYEGSLYSPASMGKEAFEHTITLNGFSKGYAMTGWRIGYFVATEEIVEAANIIQQQTITCASSISQYAALRALDDNESPARMRSEFRKRRDLAYGILSESTDMKVHKPEGAFYMFPGYSKDIPSEKIAEMLLNQEHVVVTPGSAFGDRGRHHFRISFATSEDIIKEGLERLVKFMHTL

SEQ ID NO: 18388 - protein, 286 aa, Oryza sativa (japonica cultivar-group)
MAASVPNGHSVAGEGGTPAPPPSSSSLVFLGTGCSSAVPNARCLIQPPDPPCAVCSQSLSVPPELNPNYRFSDSHALILSRIWALVSAWLLAAADGSDVLCNTSLLIDYCQDEVTHKYILIDVGKTFREQVLRWFIHHKIPCVDSIILTHEHADAILGLDDVRIVQPFSPTNDIEPTPIYLSQFAMNSIAQKFPYLVRKKLKEGEEVRRVAQLDWRVIESDLQKPFVTSGLEFVPLPTGSHNVHLCWDQTLDAVKRICPKRALLIGMTHEMDHHKDNETLEEWSRR

SEQ ID NO: 18389 - protein, 92 aa, Triticum aestivum
MAAAAKASWMAAMSVGAVEALKDQAGLCRWNYALRAIHGAAKGKASIRRGAVVSQGTKRPPASAAAVAERRRAEKAEEGLRTVMYLSCWGPN

SEQ ID NO: 18390 - protein, 426 aa, Zea mays
MSSSMQSSYLPATTESVAKAQEAKDASESISILYRVLEDPSSSADALRVKELAITNLTNYLTKENRAEDLRNLLTQLRPFFALIPKAKTAKIVRGIIDAVAKVPGTSQLQISLCKEMVEWTRAEKRTFLRQRVEARLAALLLENQEYTEALTLLSGLIKEVRRLDDKLLLVDIDLLESKLHFSLRNLPKAKASLTAARTAANAIYVPPSQQGTIDLQSGILHAEEKDYKTAYSYFFEAFEAFSSLEDPKAIFSLKYMLLCKIMVNQADDVAGIISSKAGLKYLGPDVDAMKAVADAYSKRSLKYFETALRDYKAQLEEDPIVHRHLSSLYDTLLEQNLCRLIEPYSRVEIAHIAEMIELPMNHVEKKLSQMILDKKFAGTLDQGAGCLIIFEDSKTEEIFPATLETITNVGKVVDSLYMRSAKIMA

SEQ ID NO: 18391 - protein, 481 aa, Silicibacter sp. TM1040
MKRTRNVKIVATLGPASETYETIRALHEAGADVFRLNMSHGSHDEIAVKHKIIRQVEEDLDSTIAILADLQGPKLRVGVFANGAEELEEGANFRLDLDPAEGDLSRVCLPHPEIFQALEPGASLLVNDGKIRLKVEDCGEDYANCVVTTGGTISNRKGVNVPDVILPLAALSEKDRADLEFVCELGVDWLALSFVQRAKDVFEARALADGRAAILSKIEKPAAVDNFAEILDASDGIMVARGDLGVELPVSHVPPIQKRLVRKSRAAAKPVIVATQMLESMIESPMPTRAEVSDVATAIYEGTDAIMLSAESAAGQYPIEAVQTMDKVATEVEQDPTYRDIIAASRSSKGDTIADGIVAAAREIAEKTEIKAICCFTQSGTTALLTARERPYVPILALTPLAKTARRLCLTWGCNCVVTPKVDRFKGAVVSAARAARSGGFASETDQVVVTAGVPFNVPGTTNILRIAPCDERLIYNTDPE

SEQ ID NO: 18392 - protein, 209 aa, Trichosanthes lepiniana
DEREFDYFILALQWAGTSCRSGGACCPYNGCCKADSPTQFTIHGLRPEYSGGERPSCCTGGSFDPDEIMPFFGKLVEYWPTYRCALEQSCNNRKEILWGQQYEKHGTCASPVIKGEWNYFKKTLKLFMKYNVDKALEDAGIVASNSKMYDLKDIVVAVESAVGARPKLRCDEEGLVQKLSLCFDKDFKPRDCVQVGSCPRYVSLPEIPD

SEQ ID NO: 18393 - protein, 258 aa, Zea mays
  misc_feature (48)..(48): Xaa can be any naturally occurring amino acid
  misc_feature (250)..(250): Xaa can be any naturally occurring amino acid
  unsure (1)..(258): unsure at all Xaa locations
NYRIPTHPRSQSHRTPASPPGSAPISTPPPPESGSESIFEVPLCSTGXFGKPKEQANAGALATLDKLNETLDMLEKKEKVLEKKAGAELERAKEFSKAKNKRAAIQSLKRKKLYEQQIEQLGNFQLRIHDQMIMLEAAKATTETVDALRTGAKAMKAMQKATNIDDVDKTMDEINEQTENMKQIQDALSAPLGASADFDEDELEAELEELEGAELESQLLEPVVTIPIHTTPVPGKAQPTRPAPQKASAXEDELAALQ

SEQ ID NO: 18394 - protein, 204 aa, Triticum aestivum
MGNSQASPSSASSASFVTASRAFSKQALDDLRAHFSSLAAQSGTQGRAISRPVFLDYFGVRGALGDRLFQLVAKESSVEDGVTFEGLIVSKATYERGTKDEADEFIFQLCDVMGDSILTRSDLAAVLASIHETIFADNKEAREGSNKSTFEAFLNSAVFSKDAGGVSEKSMSLSDFKNWWICMPSLRKFLGRLLMPPDSGRAGF

SEQ ID NO: 18395 - protein, 251 aa, Cryptococcus neoformans var. neoformans B-3501A
MARKFFVGGNFKMNGSLESVEKIVRSINDANLDGTNEVVIAPPALYLLKVQSELNAPTQVSAQNAFTESSGAFTGEIAPQQLKDANVHWVILGHSERRSLFGDTDKLVADKTKAAINAGLSVIACIGESLEERESDKTMTVVERQLEAIAAAIDVDAWKRIVIAYEPVWAIGTGKVATVSQAQEVHAAIRSWLSRRASPEIADSTRIIYGGSVNGKNCGELSAAKDIDGFLVGGASLKPEFIDICKSGKKA

SEQ ID NO: 18396 - protein, 438 aa, Oryza sativa
MAATTTIPLLLLLLAATVAAAAAELSVYHNVHPSSPSPLESIIALARDDDARLLFLSSKAATAGVSSAPVASGQAPPSYVVRAGLGSPSQQLLLALDTSADATWAHCSPCGTCPSSSLFAPANSSSYASLPCSSSWCPLFQGQACPAPQGGGDAAPPPATLPTCAFSKPFADASFQAALASDTLRLGKDAIPNYTFGCVSSVTGPTTNMPRQGLLGLGRGPMALLSQAGSLYNGVFSYCLPSYRSYYFSGSLRLGAGGGQPRSVRYTPMLRNPHRSSLYYVNVTGLSVGHAWVKVPAGSFAFDAATGAGTVVDSGTVITRWTAPVYAALREEFRRQVAAPSGYTSLGAFDTCFNTDEVAAGGAPAVTVHMDGGVDLALPMENTLIHSSATPLACLAMAEAPQNVNSVVNVIANLQQQNIRVVFDVANSRVGFAKESCN

SEQ ID NO: 18397 - protein, 303 aa, Gluconobacter oxydans 621H
MSSRPPASFSATFSAARSSKCVPPPRRPSTDVSLPSLRDTIQAHGLDAKKSLGQHFLLDPGICARIAALGGDLTGRSVVEIGPGPGGLTRALLDTPASRVDVVEIDERAWPLLDELATYYPDRLHVVRQDALKLDAATLAPAPRQIIANLPYNVATPLLVGWLRQASQWERLSLMFQLEVAERICAAPGSSAYGRLAVLSQWCASCSVALRIPPAAFSPPPKVHSAVAVIIPHAEQPSPQLFRAMEQVTAAAFGQRRKMLRSSLKSIGGERLLEQAEIEPTRRAETLSVAEFARLAELNLASR

SEQ ID NO: 18398 - protein, 325 aa, Triticum aestivum
  misc_feature (265)..(265): Xaa can be any naturally occurring amino acid
  unsure (1)..(325): unsure at all Xaa locations
MSGGEEGEGRKVSREDIQLVQNLIERCLQLYMNQKEVVETLSFQAKIEPSFTELVWQKLEEENPEFFKAYYVRLMLKNQINVFNKLLAHQCRLMNKDPSGALSITPTAPNGSDSSTLNQNTCFLQDTTSTAIPDSFLHNGNSSGVINGAPATDQFIYGGKVVHGLPSGMDASVSLLSAHNSTGGQFNGDNGTTIKAESSFSSNPEFAFCNENTYLEPCQSIGDASGGSFSSSELNGQPLGDTILDMDTSSYGFLSQIPRNFSFSXDLTEDFSHSTEILENYGSSPFIPSETNTFSESTAGGHTEIGNIRLDSISEGVSYEDFGSD

SEQ ID NO: 18399 - protein, 427 aa, Neisseria meningitidis MC58
MNRNEILFDRAKAIIPGGVNSPVRAFGSVGGVPRFIKKAEGAYVWDENGTRYTDYVGSWGPAIVGHAHPEVVETVCEAALGGLSFGAPTEGEIVIAEEIAKIMPSVERLRLVSSGTEATMTAIRLARGFTGRDKIIKFEGCYHGHSDSLLVKAGSGLLTFGNPSSAGVPADFTKHTLVLEYNNIAQLEEAFAQSGNEIACVIVEPFVGNMNLVRPTEAFVKALRGLTEKYGAVLIYDEVMTGFRVALGGAQSLHGITPDLTTMGKVIGGGMPLAAFGGRKDIMECISPLGGVYQAGTLSGNPIAVAAGLKTLEIIQREGFYENLTARTEQLVQGFRTAADAAGIEFTADSVGGMFGLYFAAHAPRNYADMARSNIEGFKQFFHGMLDRNVAFGPSAYEAGFVSAAHTPELIDETVAVAVEVFKAMAE

SEQ ID NO: 18400 - protein, 518 aa, Xanthomonas oryzae pv. oryzae KACC10331
MPESEDGYAAMPSLVRDVCVNFRGFYREAIMKERQRRTKILATLGPSTDAPGVLDTLFKAGVNVVRLNFSHGDPSGQAKRAAEVRAAAARVGAEVGILADLPGPKIRIERFAEGKIKLTMGDRFDLVADANAPAGDQHQVGVSYLGLPQDVTAGDVLLLDDGLMQLQVTDVQGARIVTTVLNDGVLSDRKGLNKQGGGLSLGALTERDKELIGIVAKIGVDFIAVSFCRNAQDMQDARQIAKQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRFLSRFRSNMPIYAFTRHDGARRQMAMMRGVFPINFDSRGLTPREAARAAIRLLVENERMGPGDRVVFTSGEHMETHGATNTLRLLEVGDDGRATGLGEL

SEQ ID NO: 18401 - protein, 532 aa, marine gamma proteobacterium HTCC2207
MEYRSYYAIYCAIFVSLGGFVFGFDASVVSGIIGPVTIEFGLTPIQAGFVVAAPTLSSAIGTLMIGPLSDAFGRKKILMFIAVLYLISAVSSALSTSYYMLLAARALGGFAFTSLVIAPMYIAEIAPAKRRGKLVSVNQLNIVIGLSAAYFANYYILGLSSSGADWVSAWGVDQHAWRYMLGFEIVPALIYLVALFAIPDSPRWLIQKGREQEARAVIAKLVPADQVDSEMSLITQSSATVTESLWARIGGIFGPKMRLALIVGIIVAVVQQITGINAIFFYAPTIFEQSGIGTDAAFAQAVLVGLINVVFTLVAIALIDRWGRRPLLLVGLSGIAISMALCTYGFSQATYELKSESVVQMQQMETADANFDASQLNSLVGVVYQSDVEFKTAVSEAIGIEAARKYESELIKSSAQMNALLILVGILGFVASFAMSLGPVMWALFSEIFPNQLRGVAISFVGMINSMVSFMVQLLFPLELSVLGAALTFFSYFVFAVIGLILVAWLLPETKGKSLEELETMFGTKASTGSPA

SEQ ID NO: 18402 - protein, 427 aa, Burkholderia xenovorans LB400
MSKNETLFERAQRTIPGGVNSPVRAFRSVGGTPRFIERAQGAYFWDADGQRYIDYIGSWGPMILGHVHPEVLEAVQRVLGNGFSFGAPTESEVEIAEEICKLVPSIEQVRMVSSGTEATMSALRLARGFTNRTRIVKFEGCYHGHADSLLVKAGSGLLTFGNPTSAGVPADIAKHTTVLEYNNVAELEEAFKAFGNEIASVIVEPVAGNMNLVRATPEFLQALRRLCSEYGSVLIFDEVMCGFRVALGGAQEVYGITPDLTCLGKVIGGGMPAAAFGGRRDIMAHLAPLGGVYQAGTLSGNPIAVAAGLKTLQLIQAPGFYDTLAARTTRLAQGLANVAREARVPFAADSLGGMFGLYFTESIPTSFAEVTQSDVPRFNAFFHKMLDAGVYFAPSAYEAGFVSIVHDDAIIDATIDAARGAFASLAA

SEQ ID NO: 18403 - protein, 241 aa, Synechococcus elongatus PCC 6301
MLLNTRKPVMDPVTHMKHEVAKAAASRVQSGMVVGLGSGSTAALMIQYLGDRVRNGELTNIQAVPTSFQSSVLANEYGIPLTTLNEVDRIDIAIDGADEVDPQRNLIKGGGACHTREKLVDARAEQFIVVVDSSKLVEALGTTFLLPVEVLPEAYIQVGKALEKLGGKPELRMAVKKAGPVVTDQGNLVLDVKFDRIDQPAELEKAINNIPGVLENGLFVGLTDLVLVGEVDGDRVSVREF

SEQ ID NO: 18404 - protein, 165 aa, Arabidopsis thaliana
  misc_feature (18)..(18): Xaa can be any naturally occurring amino acid
  misc_feature (32)..(32): Xaa can be any naturally occurring amino acid
  misc_feature (59)..(59): Xaa can be any naturally occurring amino acid
  misc_feature (92)..(92): Xaa can be any naturally occurring amino acid
  misc_feature (104)..(104): Xaa can be any naturally occurring amino acid
  misc_feature (140)..(140): Xaa can be any naturally occurring amino acid
  unsure (1)..(165): unsure at all Xaa locations
MQAVLVDETKNTAVLQIXYYIEEGRKSDDKSXAKTRNPETIKSVEWKLMEKGVQRMDRXPSDGIPLRRPPSKSCHGVQVHVREGPDRMEDYXEMQPDPPAMDEXDPNCDEEQVNKSGDDVAAELVKGKVEVPKEVPAGVXRAEGDPRLVGRLDVDRGGRQMLRRL

SEQ ID NO: 18405 - protein, 378 aa, Burkholderia xenovorans LB400
MTLASTPEIIAELKAGRMVILVDEEDRENEGDLVIAAEFVTPEAINFMARYGRGLICLTLTQERCKLLNLPLMTYRNGTQYGTAFTVSIEAAEGVTTGISAADRARTIATAVAPDAKAEHIVQPGHVFPIMAQPGGVLVRAGHTEAGCDFTALAGLTPAAVICEVINDDGTMARLPDLMEFAKEHGLKIGTIADLIHYRSRTESIVERICERTMQTAHGAFRAVMYLDQPSGQPHIALVRGTPCTDQDTLVRVHEPLSVLDLLEVGESTHSWTLDAAMKEIARRDCGVIVLLNCGDSKDHLIDVFKAFDSKERAEALKRRPVDFKTYGIGAQILRELGVGKMQVLSNPRKLGSMSGYGLEVTGFVPMPGSTAQAPQQG

SEQ ID NO: 18406 - protein, 202 aa, Glycine max
MGSSGFSWKLADHPKLPKGKTVAVVVLDGWGEATPNEYNCIHKAETPCMDSLKKGAPERWRLVRAHGTAVGLPTEDDMGNSEVGHNALGAGRIFAQGAKLVDLALASGKIFEGEGFKYIKECFENGTLHLIGLLSDGGVHSRLDQLQLLLKGVSERGVKRVRVHILTDGRDVLDGSSVGFVETLENDLANLRAKGVDARIAS

SEQ ID NO: 18407 - protein, 248 aa, Zea mays
MGRQFFVGGNFKMNGTIKSITEIVDNLNKAKLDENTEVVIAPPSLYLLLTREHLRKGIEVAAQNIFDKPNGAFTGEISVEQLKDSGITWTILGHSERRQILQENDDFVASKTKAAVDGGLGVILCCGESLEQREAGETVNVVTKQLKAVADKVKDWSKIVVAYEPIWAIGTGKVATTEQAQEVHAALREWLKKEVSAEASEKTRILYGGSVSEKNCKELAKRPDIDGFLVGGASLKPAFVDIINSHQA

SEQ ID NO: 18408 - protein, 346 aa, Volvox carteri
MQTMRAPAAQGAATRVASRRVFRPVASTKVSTAVTTDVSKRTVPTALEEGEMPLNTYSNKAPFKAKIRSVETITGPKATGETCHIIIETEGKIPFWEGQSYGVIPPGTKINSKGKEVPHGTRLYSIASSRYGDDFDGKTASLCVRRAVYVDPETGKEDPAKKGICSNYLCDATPGTEIVMTGPTGKVLLLPADANAPLICVATGTGIAPFRSFWRRCFMENVPSYKFTGLFWLFMGVANSDAKLYDEELQALAKAYPSQFRLDYALSREQKNRKGGKMYIQDKVEEYSDEIFDLLDNGAHMYFCGLKGMMPGIQEMLERVAKSKGLNYEEWVEGLKHRNQWHVEVY

SEQ ID NO: 18409 - protein, 393 aa, Vitis vinifera
MNVPATREDLMIVNMGPHHPSMHGVLRLIVTLDGEDVIDCEPILGYLHRGMEKIAENRTIIQYLPYVTRWDYLATMFTEAITVNAPEQLGNIQVPKRASYIRVIMLELSRIASHLLWLGPFMADIGAQTPFFYIFRERELVYDLFEAATGMRMMHNYFRIGGVAADLPHGWIDKCLDFCDYFLTGVAEYQKLITRNPIFLERVEGVGIIGVEEAINWGLSGPMLRASGIQWDLRKVDHYECYDEFDWEVQWQKEGDSLSRYLVRIGEMVASIKIIQQALEGIPGGPYENLEIRCFDRARDPELNDFEYRFISKKPSPTFELSKQELYVRVEAPKGELGIFLIGDQNVFPWRWKIRPPGFINLQILPQLVKRMKLADIMTILGSIDIIMGEVDR

SEQ ID NO: 18410 - protein, 334 aa, Gibberella zeae PH-1
MQSILQKATGIGPQVIKPENLQGRVAIVTGGALGIGYEVSRALAHAGCKVIMVNRKEEQGTSAIEAVKNEKHDADIDWKECDMGNLSQIREVFGGFRESLDRLDFLVLSAGINTNQFGLDSDGIERHFGVNFLGHFYVCNQLWPLLRKTSKMENVSPPRVVFEASEMHRLAQLSNVQFKTKEEINDPDLDPTARYNRTKLAMILFAKYGLAGKVIAENKDKIYALSVHPGAVNTAMQQQWKDAYPGLTGKLLSWTMQAIGRDVEQGSYSALWALTSSRIEEENLNGYYFVDPDKEGEETSQASNPELASNLWDLSTSFIKEKLGEDALADWNGS

SEQ ID NO: 18411 - protein, 117 aa, Zea mays
MKRSAASTVPLALVLIAVATTAAAADMTGASNYLVYVEPHPPGVDCQAYQLGILAAALGGEAQAKAAMLYNYRNVMSGFSARLTPPELEAVKKQPQVSRVLPSATLSLMSSKFDGVS

SEQ ID NO: 18412 - protein, 453 aa, Listeria innocua
MEASLLKKNQSVELTIEDLTHDGSGVGKIDGYPLFIPNALPGEKITAKITKLNKNYGFARMENIEVVSAERVEPPCAVYSKCGGCSLQHLSYDGQLAFKRNQVEETMKRIGKLNVEVPDTLGMENPWRYRNKSQVPVGFVNGKLTAGFYQKRSHDIIDMSTCLIHNEKGDVAVQKTREILAKYGTEPYDEKTGKGDIRHIMTRFAHTTGQLMIVLVTTKERLPFKAEIIQDLTNQLEVTSIVQNINPQKTNVIFGDRTKTLWGSDIIEDTIHGIRFAISARSFYQVNPLQTEVLYQQAIDSAELTGEETVIDAYCGIGSISLCLAKKAKHVYGVEIVDQAIQDARANAELNNLTNTTFETGKAEEVIPQWYKNGIVADVLVVDPPRKGCDETLLETILAMKPKKVVYVSCNPGTLARDMKILTEGGYEAKKVQPVDMFPMTTHIEAVTVLTLK

SEQ ID NO: 18413 - protein, 310 aa, Triticum aestivum
  misc_feature (163)..(163): Xaa can be any naturally occurring amino acid
  misc_feature (198)..(198): Xaa can be any naturally occurring amino acid
  misc_feature (232)..(232): Xaa can be any naturally occurring amino acid
  misc_feature (250)..(250): Xaa can be any naturally occurring amino acid
  misc_feature (254)..(254): Xaa can be any naturally occurring amino acid
  unsure (1)..(310): unsure at all Xaa locations
MAFSSLATPSSSSPSSSFTLPTKPSPGAGSLSFSRASTGKFRMAAVRAEAVDTSISPRVSALRPSKTMAITDMASALRQAGVPVIGLAAGEPDFDTPAVIAEAGINAIRDGSTRYTPNAGTMELRKAICNKLQEENGLTYSPDQVLVLIPAPFWVSYPEMARXAGATPVILPTSISDNFLLKPESLASVITEKSRLLXILCSPSNPTGSVYPRELLEEIAAIVKKYPKLLVXSDEIYEHIIYHPAKHTSXAALXGMYDRTLRNGFLRLCKAGTGTCPKHLSCGSQSSGALFGGLTPGIREPLNQASGYFI

SEQ ID NO: 18414 - protein, 99 aa, Arabidopsis thaliana
  misc_feature (54)..(54): Xaa can be any naturally occurring amino acid
  unsure (1)..(99): unsure at all Xaa locations
MVSSMLSSAAVVTSPAQATMGAPFTGLKTSAEFPVTRKTNKDITSIASNGGRVXCMKVWPPIGKKKSETLSYLPDLSDVEIGSGKWTTLPRKKAGFPWG

SEQ ID NO: 18415 - protein, 293 aa, Zea mays
MGRHQAGRRAILFEETLYQSAVDGRKIVDILAEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 18416 - protein, 378 aa, Burkholderia xenovorans LB400
MQDGRTTLSKFLIDTLDRQPCSTETARNAGLSALLIDVAAAIKSISAMLTKGALGGNYGSAQSINTHGEEQKKLDVATNEIFVQQCEWDGLLAAMVSEEMESVYAIPPGYPRGDYLLAFDPLDGSSNIDINGVVGSIFSVLRNGEGNGNANEKNGSDPRGTVGESAFLRPGCEQVAAGYAVYGPSTMLVLSVGNGTHGFTLEREIGNFVLTHSNIRIPEDTVEFAINASNERFWEPPVRRYVQECKDGRSGCRASDFNMRWIASMVAEVHRILMRGGVFMYPRDSKTPAMEGRLRLLYEANPMSFLVEQAGGLSITGRERILDVVPRALHGRVPVILGSKHEVERIGRYHGEYDRGEDQPFTSPLFSRRSLFLPGFTA

SEQ ID NO: 18417 - protein, 228 aa, Staphylococcus aureus subsp. aureus MRSA252
MKDVKALKLMTLNDVLSQINGDMTLGIGTGSTMELLLPQMAQLIKERGYNITGVCTSNKIAFLAKELGIKICEINDVDHIDLAIDGADEVDPSLNIIKGGGGALFREKVIDEMASRFVVVVDETKMVQYLGETFKLPVEVDKFNWYHILRKIESYADIKVERRVNEDVAFITDNGNYILDCKLPKGIDPYKFHEYLIHLTGVFETGYFLDMADQVIVGTQEGVKILEK

SEQ ID NO: 18418 - protein, 457 aa, Bacteroides fragilis YCH46
MNRENKPLFLYTFITVFGGLIVGLNMAGISGAVPFLQEQFMLDDMALGLVVSILTVGCLCGALLGGGFSDRYGRQKVMFSSAVFFIVSSLGCALSGNLVSLLVFRLICGLGIGVISAVAPIYISEISPARLRGTLVSYNQLAIVIGILIAYIVDYILLDYERNWRLMLGFPFFFSVAYLLLLGILPESPRWLSARGKAGRARQVASKLNLEAGEMTVSDTNTQEGRDRIKVTELFKGNLAKVVFIGSILAALQQITGINVIINYAPSIFEMTGVAGDIALVQSILVGVVNLLFTLIAVWLVDKVGRKILLLCGSLGMGISLLYLVYTFVVPAANGIGALIAVLCYIGFFAASLAPLMWVVTSEIYPSRIRGTAMSLSTGISWLCTFLTVQFFPWILNNLGGSVAFGIFAVFSIAAFAFILFCVPETKGKSLEAIEKELGVDKEAEENVKEEHAFSKI

SEQ ID NO: 18419 - protein, 445 aa, Thiomicrospira crunogena XCL-2
MEHSENRTPKYQENSLTLIGAVALGTGVMIGAGIFALTGQMATMTGVLFPLAFLSAALIVSFSAYSYVKMSNAYPSAGGIGMYLYKAYGNSLSTAFNALLMYFSMVIAQSFLARTFGEYTLQLFDTDNNEIWVPVLGVGLLLVAFLINLSTNRLIGGVASFIGFLKIGGIIIFGLVGIWAADNIAMDFTQTTPDSSTLSGFLGATALGILAFKGFTTITNSGSELKDPHHNVGRAITISIIFCVVIYTLVGFAVASNLSLSDIIATQNYSLAAAAKPALGNYGLWFTVVLAMLATAGGIIASIFAVSRMLAMLTEMKLVPHSHFGMSGNIQKHTLLYTVVLGLFLTAFFDLSRIAALGIIFYLIMDIAVQWGILRYLRKEIHANLLILFTAIMLDLLVLGGFLWVKIMSDPMVVGVAIISMAIIAIVEFVFLRNQRLTNSSSLTK

SEQ ID NO: 18420 - protein, 320 aa, Coccidioides immitis RS
MSQDITFKLSNGVTIPGLGFGTFSNEGAKGETYKAVLHALKVGYRHLDCAWFYMNEDEVGQAIKDFLKENPSVKRSDLFVTTKVWSHLHEFDEVQWSLNNSLKNLQLDYVDLFLVHWPIAAEKDENYMPKLGPDGKYVIKEELTNNPEPTWRAMEALYNAGKTRAIGLSNFTIPGIKQILSFAKVAPHVNQIEIHPFLPNSELVEFCFSQNILPEAYSPLGSQNQVPNTGEKVATDPTLNAIAKEGGHTLAQVLIAWGLKRGYVVLPKSSTPSRIESNFKEIELTQEQFEAVNRVAQGRHCRFVNMKDAFGYDVWPEESA

SEQ ID NO: 18421 - protein, 166 aa, Brassica napus
  misc_feature (11)..(11): Xaa can be any naturally occurring amino acid
  misc_feature (19)..(19): Xaa can be any naturally occurring amino acid
  misc_feature (21)..(21): Xaa can be any naturally occurring amino acid
  misc_feature (31)..(31): Xaa can be any naturally occurring amino acid
  misc_feature (36)..(36): Xaa can be any naturally occurring amino acid
  misc_feature (39)..(40): Xaa can be any naturally occurring amino acid
  misc_feature (42)..(42): Xaa can be any naturally occurring amino acid
  misc_feature (45)..(45): Xaa can be any naturally occurring amino acid
  misc_feature (48)..(48): Xaa can be any naturally occurring amino acid
  misc_feature (51)..(51): Xaa can be any naturally occurring amino acid
  misc_feature (55)..(55): Xaa can be any naturally occurring amino acid
  misc_feature (60)..(60): Xaa can be any naturally occurring amino acid
  misc_feature (63)..(63): Xaa can be any naturally occurring amino acid
  misc_feature (67)..(69): Xaa can be any naturally occurring amino acid
  misc_feature (75)..(76): Xaa can be any naturally occurring amino acid
  misc_feature (88)..(89): Xaa can be any naturally occurring amino acid
  misc_feature (91)..(93): Xaa can be any naturally occurring amino acid
  misc_feature (95)..(96): Xaa can be any naturally occurring amino acid
  misc_feature (100)..(102): Xaa can be any naturally occurring amino acid
  misc_feature (105)..(107): Xaa can be any naturally occurring amino acid
  misc_feature (115)..(115): Xaa can be any naturally occurring amino acid
  misc_feature (119)..(120): Xaa can be any naturally occurring amino acid
  misc_feature (139)..(139): Xaa can be any naturally occurring amino acid
  misc_feature (147)..(148): Xaa can be any naturally occurring amino acid
  misc_feature (151)..(151): Xaa can be any naturally occurring amino acid
  misc_feature (153)..(153): Xaa can be any naturally occurring amino acid
  misc_feature (155)..(156): Xaa can be any naturally occurring amino acid
  misc_feature (159)..(163): Xaa can be any naturally occurring amino acid
  unsure (1)..(166): unsure at all Xaa locations
SEKKKKKKSVXASSMLSSXAXVTSPAHATMXAPFTXLKXXAXFPXTRXANXDITXIASNXGRXSCMXXXPPVGKXXVETLSYLPDLTXXEXXXEXXYLLXXXWIXXXEVELEHGXVYRXXGSTPVYYDGRYWTMWKLPXFGCTDSAXXLKXAXNXXGEXXXXXRDI

SEQ ID NO: 18422 - protein, 338 aa, Magnetococcus sp. MC-1
MVEKMAKGALSSLDEKLVALLVAHGEIPCSGAAIGAGLGISRAAVWKHIQGLRQRGYRIEALHRRGYRLLGEPDFPSLERMQPYLTALSLLHPKQAYFFAETDSTNARASQLARDGAPEGTLCCADAQSGGRGRMQRVWVSPAGENLYFSVVLKPAIAPNDAAQITLLAGLALAQTLRDDLHIEDLYLKWPNDILIGGRKVAGILTEMMAEPERVRYIVVGVGVNVNGRVGDMPADLQCIATTLRESSGRSFDRSQLLARFLDRLGYWYRQFLQGGFAPLRESWLQYGDIQGRRVRVNFYAESFTGVAESMDQNGCLLVTRDDTGALTTVVAGDVNLL

SEQ ID NO: 18423 - protein, 591 aa, Crocosphaera watsonii WH 8501
MTSSSISRRTKIVATIGPATQNKEILRQLILAGATTLRLNFSHNDHDYHQNSIRLIRQTAFELNQPVAILQDLQGPKIRLGQFANGPITVQPGDVFILTSREVECNQTISYVSYEHLADEVPEKARILMDDGKVEMLVEKVDKENKDLHCRVVVGGVLSDRKGVNFPGVYLSVKALTEKDKRDLMFGLDQGVDWVALSFVRNPQDILEIKGLIASAGKNVPVIAKIEKHEAIEDMEEILSLCNGVMVARGDLGVELPPEDVPILQKRLISTANRLGIPVITATQMLDSMASNPRPTRAEVSDVANAILDGTDAVMLSNETAVGKYPVEAVATMATIAERIEREPTIPKVLSEKKQSVTNSISSAVSHIAQELNAAAIMSLTKTGSTARNVSKFRPQIPIVAVTPHVDVARQLQLVWGVKPLLVLDLASPNQTFQSAVNVAQENNWLKDGDLVVMTAGTLQGVAGSTDLIKVEMVKAVLGKGVGIGQGAASGRARIAHNARELGNFEPGDILVVPGTNAEFVEMMRKASGIITEEASLTSHAAVIGLRLGVPVIIDFKEATANIREGAIITVDAEKGQVYSGLVTSNNNGNK

SEQ ID NO: 18424 - protein, 477 aa, Rhodopseudomonas palustris CGA009
MRRLRRIKILATLGPASSDSAMIRKLFEAGADVFRINMSHTPHDKMRELVKTIRNVESSYGRPIGILVDLQGPKLRLGSFANGPIQLNNGSNFVLDSIKEPGDETRVYLPHPEILAALKVGDALLLDDGKVRLICEETQGDRAVTRVVIGGKMSDRKGVSLPDTDLPMSAMTNKDRADLEAACETGIDWVALSFVQRAEDVVEAKRMIRGRAAVMAKIEKPQAIDRLEDILDVSDALMVARGDLGVEMPLERVPSLQKQMTRMARRAGKPVVVATQMLESMISSPVPTRAEVSDVATAVYEGADAIMLSAESAAGKYPVEAVSTMNRIGEEVERDVTYRTVVTAQRPDPEATAGDAIAGAARQIAETLDLSAIICWTSSGSTALRVARERPKVPVVAITPSLHTGRKLSAVWGVHCVVAEDAKDQDDMVERAGRIAFRDGFAKSGQRVIIVAGVPLGTPGATNMVRIAYVGPSDADV

SEQ ID NO: 18425 - protein, 228 aa, uncultured cyanobacterium
HEVAGAGQHELGMKYAELIEAADNVMIYKYIVRNVARKYGKTATFMPKPVFNDNGTGMHVHQSLFKGGQPLFFGEGTYANLSQTARWYIGGILKHAPSFLAFTNPTTNSYKRLVPGFEAPVNLVYSLGNRSAAVRIPLTGPNPKAKRLEFRPGDALANPYLAFSAMMMAGVDRIKNQIDPGDGFDEDLFELPAERLASIPTVPASLNGSLEALNADKNYLMEGGVFTE

SEQ ID NO: 18426 - protein, 310 aa, Ralstonia solanacearum
INGFGRIGRMVFRAAVANFKDIEVVAINDLLEPDYLVYMLKYDSVHGRFDGEVAVDGNTLIVNGKKIRLTAVKDPAELKWGEVGADVVVESTGIFLTKEGAQKHIDAGAKKVIMSAPSKDDTPMFVYGVNHGTYKGEAIISNASCTTNCLAPVAKVLNDKWGIKRGLMTTVHAATATQKTVDGPSNKDWRGGRGILENIIPSSTGAAKAVGVVIPELNKKLTGMSFRVPTSDVSVVDLTVELEKAATYDEICAEMKAQSEGALKGVLGYTEDKVVATDFRGDARTSIFDAEAGIALDGTFIKVVSWYDNE

SEQ ID NO: 18427 - protein, 110 aa, Zea mays
KRGGDDELPVATPVQFHTTGRLSFCSFSFPRLSELGVRQWPKWGCEKSKFPWTYSAKETCYLLQGKVKVYPEGHGEEFVEIGAGDLVVFPKGMSCTWDVAEAVDKHYNFE

SEQ ID NO: 18428 - protein, 181 aa, Glycine max
MAYSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 18429 - protein, 322 aa, Yarrowia lipolytica CLIB122
MSLNRSKFTEYKQTARNFWAGKPRFTEENYPSLDGKTFLITGGHSGVGLESTKLLISKGAKVVIVGRSKDKAQEVLAELPSQQYEFVEANLADLTTIKAAGEYIQNNYPELQGVILNAGVMIPPYSKTPQGHELQWGTNVVGHHALMKYLGPILIHTAKSSPKNSVRVIWVSSSATVVSPYEGGINFDDINLDKVDSPNDHILYSQSKIGNAYQAYLWSKHHPGSGVVSVSVDPGNLRSNLQRHGNGVLFYVLDYFLYPAKFGAYTELSALLNTEVRDTDHLIPWGQVGHLRNDVDYCRRGDKGEALWQQLDSDVKDFVAKL

SEQ ID NO: 18430 - protein, 257 aa, Neisseria meningitidis MC58
MYRQIGMWDQKWVIGNWKMNGRLQNNNALMHRFRIHPTAERVLIGLAAPTVYLLQLHNAMQIVLNNRILTCAQDVSRFPNNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 18431 - protein, 242 aa, Triticum aestivum
MASPMVGTPIRLSSLRYAPPSPAPRGRFVAARVRASAEAMATATEKLGVRVERNPAESRLSELGVRQWPKWGCEKSKFPWTYSAKETCYLLQGKVKVYPGGGGGGPGDNTARGRREEKQHKAAGAWGRGEGRSEGDRRPEGWKRRWERGARRKPNATGQGTAQGVAGNGGARQGTYARRPPCTQQPRLDRRPQGQSADQGTADDVRSVGTSMRKGHSPLIRRGAEEDDAGRRGVRREEERGH

SEQ ID NO: 18432 - protein, 252 aa, marine gamma proteobacterium HTCC2207
MKANGEKFAVITAYDFTFSKLIETAAIEVVLVGDSLGNVVQGRDSTLPVTIDDMAYHTEAVKRGNNRALLMTDMPFMSYATEVQALDNAAILMQAGAQMVKLEGGAWLADTVYLLSQRGIPVCGHVGLTPQSVHKLGGYKVQGKEDQAAELMIADALALEDAGAELIVVECVPSALGKQLAEALTIPVIGIGAGPDTDAQVLVLHDMLGISQRLPRFSKNFLEEQTCIQDAITAYGAAVRDGTFPAPEHCFK

SEQ ID NO: 18433 - protein, 485 aa, Magnetospirillum magnetotacticum MS-1
MTDLDASLLKTHAYIDGHWAEADDGRRFDVLDPATGHLLASVPDMGGAETRRAIEAAEMAWGPWRRRTAKERAAILMAWFEQIIAHKDALARLLSAEQGKPLPEAQGEIVYGAAFIQWFAEEGKRAYGDLIPTTASDRRLLVMKQPIGVVAAVTPWNFPMAMITRKCAPALAAGCPVVVKPAEDTPLSALVLAELAERAGLPRGVFNIVTTRQPGAVGGEMTANPLVRKLSFTGSTRVGKMLMAQCAETVKKVSLELGGNAPFIVFDDCDLDAAVAGALASKYRNSGQTCICTNRFLVQAGVYEEFGRKLAEKAAAMVVGHALKGPVQQGPLINAAAVAKVASHVADAVSKGARVLTGGRPHELGGGFWQPTVLADVTAQMLCFQEETFGPVAPLVRFETEEEAVELANASQFGLAGYFYSRDLARVFRVAEAMECGMVGVNESLISNEVAPFGGIKESGLGREGSKYGLDDFMETKYVCIGGLS

SEQ ID NO: 18434 - protein, 366 aa, Mesorhizobium loti MAFF303099
MPYDQKKIVEAIRAFERGEIVVVMDDDGRENEGDLIVAAVHCTPEKMAFIVRNTSGIVCTPMPREEAKRLNLQPMVADNDSAHTTAFTVSVDFKHGTTTGISADDRTLTVRNLANGNVGASDFVRPGHIFPLIAREGGVLMRSGHTEAAVDLCKLAGLPPIGVISELVNDDGTVKRGPQVQAFAEEHGLKQVSVADLIAYRQRKETLVERVACSDIDTLGGKAQVFTYTLPWDTMHHVAVVFGDIRDGEEVPVRLHSEDVVTDVFGTSHRLDGIMKAMGERKRGVIVYLREGSVGVAHQERKRPLSGDREDHEEARRRENEWREIGLGAQILKDLGISSINLIASRERHYVGLEGFGIHIAKTEIL

SEQ ID NO: 18435 - protein, 470 aa, Saccharophagus degradans 2-40
MTDSALPSGENKSFVILISCIATIGGFLFGFDSGVINGTVDGLVTSFGVTKTAVGVHVAFMLLGCAVGAAAAGRLADLYGRRAMLIVAAILFIVSAWGSGVATGIVEFDIYRLLGGLAVGAASVMAPAYISEVAPARYRGRLTTIQQVAIISGLTAAFLSNYVLAHTAGSSLEPFWMGIATWRWMFWIEIAPAAIFFFALMVIPESPRFLVASGKKDKALTVLTKLYGAQAAPGKVAEIDSSLDHDHKPRLSDLISKVTGKVRPIVWVGIGLATFQQLVGINVIFYYGSILWQSVGFSEDHALLINVVSGAVSIGAVVLSLVLVDKIGRKPLLWIGSAGMAVTLTLTAIAFATGTLDANGDLQLSDNMGILALVAANVYVIFFNMSWGPVMWVMLGEMFPNQIRGSGLAVAGLFQWGSNWAITMSFPALLAGLGLAVTYGFYALCAFISIIFVIKYVNETNGVELEDMEG

SEQ ID NO: 18436 - protein, 228 aa, uncultured cyanobacterium
HEVAGAGQHELGMKFAQLIQAADNVMTYKYVVRNVAKKYGKTATFMPKPVFNDNGSGMHVHQSLWKEGQPLFFGEGTYANLSQTAQWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGDGEDRDLFELPAEELSKIATVPASLNGALEALNADRGFLTAGGVFSD

SEQ ID NO: 18437 - protein, 84 aa, Oryza sativa
  misc_feature (7)..(7): Xaa can be any naturally occurring amino acid
  misc_feature (29)..(29): Xaa can be any naturally occurring amino acid
  misc_feature (40)..(40): Xaa can be any naturally occurring amino acid
  misc_feature (77)..(77): Xaa can be any naturally occurring amino acid
  unsure (1)..(84): unsure at all Xaa locations
MSKSENXYSAARELIPGGVNSPVRAFTGXWGGTPLFIEKXADGAYLYDVDGKAYIDYVGSWGPMVLGHNHPAIRNAXYIVKRRE

SEQ ID NO: 18438 - protein, 228 aa, uncultured cyanobacterium
HEVAGAGQHELGMKFAQLIEAADNVMTYKYVVRNVAKKYGKTATFMPKPVFNDNGTGMHVHQSLWKGGQPLFFGEGTYANLSQTARWYIGGILNHAPAFLAFTNPTTNSYKRLVPGFEAPVNLVYSEGNRSAAVRIPLTGPSPKAKRLEFRSGDALANPYLALSAMLMAGLDGIKNQIDPGDGEDRDLFELVAEELSKIATVPASFNGALEALNADRAFLTAGGVFTD

SEQ ID NO: 18439 - protein, 228 aa, Synechococcus sp. WH 8108
HEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELPAEELSKIATVPASLNGALEALNADRGFLTAGGVFSD

SEQ ID NO: 18440 - protein, 1136 aa, Candida glabrata CBS 138
MAGFKFSMKQLGHHGKKNKNSAPESVPNPGGFNSSYNNDAGVNSQRDVGPVPGPFRSVSGNSMGSGHSVPNQQSFARNVSGSHMDNVGAGVQQAARQNIGNSMHITGFSASSTSNPHEMKQRNVSNLQQSNPHTRRILPSEPDYTPWGRIRLSNSPFPRYRHVSSSHITDQGKIYVIGGLHDQSVYGDTWILTASDIDKTGAINSFKSTTIEITESTPPPRVGHASTLCGNAFVVFGGDTHKVNSDGLMDDDLYLLNINSYKWTIPKPVGQRPLGRYGHKIVTISAEQTKLYLFGGQFDDTYFGDLAVFDLSSFRRPDSHWVFLKPSGFNPPPLTNHTMVTYQDKIWVFGGDTLEEGLINRVYLYSPTNNSWEIVETTGDIPPPMQEHAAIVYKDLMCVVGGKDAEDNYLNTLYFLNLQSLKWFKLPFYKNNIPQGRSGHSVTLLKNDQILIMGGDKYDYSSSTENMHISDVDMGKGTILYTLNLADVGTVCPGIFDNTRPVTRSPTTPKFSNKGEDATSPNIMVGKPPGLHQEPQILTPAQEQMQTPKQQIVMDMDKTPKDYVEKEPEAAHVEGQAFGKGTIGTVISENRKPSSPVPQLIESSEDGVKRTPTIASAKQLSSGPPQQKTPEKRMISDESSSKFSELDQDDSIDDEVGVAHIATSPAKNGFKMTSTENTITAAMESSSPDVLLPEIKKHMSEGTEAKTVTHSSDMDDQTTMISSRHNVVEDRQSPPQLKEAVDMKIDSPTLEDTSANLERAQVEKFPEVVARQVGAVVPNLVPNQSTGMASNSVLGMKKENNMSREHFENLRDELSKIKQAALEKANAADNHIRELESELNKLRAEQQKQKEDNKKMEDEISQFRKRYDLLDADYKEMEDTLQQYEDILAAKVLDAEKFNGIIKVQSDKIDELKLHVVNSEEFEKLKIQNEVLEKENQDLKDKLKEKDNNLDKSIVMFSGTVDELLKNWRMTSKKDTSSASPVAATQSQSTKNRNIISKMNNRLDDLLVKSKELTESEEQIDSEYEQLEIKNESIQSQARHSSISVKETASDIANAMNESKRKIEDYKAHTEKLQNEIDGLKGKVNHTDGEISLDKQSEEKLREEIEKITAEKEELNRQMQGLKMKIQSSSDNLAIL

SEQ ID NO: 18441 - protein, 228 aa, uncultured cyanobacterium
HEVAGAGQHELGMVYEELIQAADNVMTYKYVVRNVAKKYGKSATFMPKPVFNDNGTGMHVHQSLWKGELPLFFGEGTYADLSQTARWYIGGILKHAPSFLAFTNPTTNSYKRLVPGFEAPVNLVYSEGNRSAAVRIPLTGPNPKAKRLEFRSGDALANPYLAFAAMMMAGIDGIKNQIDPGDGFDGDLFELPAEQLKNIATVPASLNGALEALNADHHYLMEGGVFSK

SEQ ID NO: 18442 - protein, 475 aa, Zymomonas mobilis
MTEGLFPRGRKVRVVSTLGPASSTAEQIRDRFLAGADVFRINMSHGTHDEKKVIVDNIRALEKEFNRPTTILFDLQGPKLRVGDFKEGKVQLKEGQTFTFDQDPTLGDETRVNLPHPEIFKALDKGHRLLLDDGKIVVRCVESSPTKIVTRVEVPGPLSDHKGFNVPDVVIPLAALTPKDRKDLDFALKEKADWVALSFVQRVEDVIEAKELIKGRAPLLVKLEKPAAIENLESILAATDAVMVARGDLGVECLPESVPPTQKRIVERSRQLGKPVVVATAMLESMIKAPAPTRAEVSDVANAIYEGADGIMLSAESAAGDWPHEAVNMMHRIASYVENAPGYIERVRFTPTPAEPTTVDALAENASKTAETVGAKAIIVFTETGKTAQRVSRARPVAPILSLTPDAEVARRLGLVWGAQPVQVSTVKTLDEAKKLAAETAKKYGFAKAGDKLVVVAGEPFGKAGTTNIVDVIEA

SEQ ID NO: 18443 - protein, 228 aa, uncultured cyanobacterium
HEVAGAGQHELGMKFAQLIEAADNVMIYKYVVRNVAKKYGKTATFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKIATVSPSLNGALEALSADRAFLTEGGVFTD

SEQ ID NO: 18444 - protein, 472 aa, Escherichia coli CFT073
MPLNKKDTQGKGVKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASINNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRKVN

SEQ ID NO: 18445 - protein, 341 aa, Yersinia pestis biovar Medievalis str. 91001
MKALSKLKAEEGIWMTDVPQPELGHNDIMIKIRKTAICGTDVHIYNWDEWSQKTIPVPMVVGHEYVGEVVAIGQEVKGFNIGDRVSGEGHITCGHCRNCRGGRTHLCRNTVGVGVNRPGSFAEYLVIPAFNAFKIPDNISDELAAIFDPFGNAVHTALSFDLVGEDVLVSGAGPIGIMAAAVCKHVGARHVVIADVNEYRLDLARKMGVTRAVNVSKENLNDVMTELGMTEGFDVGLEMSGAPPAFRSLLNSMNHGGRIAMLGIPPSDMSIDWNQVIFKGLFIKGIYGREMFETWYKMAALIQSGLDLTPIITHRFPIDEFQQGFDAMRSGKSGKVVLSWD

SEQ ID NO: 18446 - protein, 515 aa, Yersinia pestis biovar Medievalis str. 91001
MSSTKKPLVLTILDGYGHREEQQDNAILNAKTPVMDVLWQQQPHTLIAASGLDVGLPDGQMGNSEVGHVNLGAGRIVYQDLTRLDKEIKEGDFFTNPTLTAAVDNAVKTGKAVHIMGLLSAGGVHSHEDHIMAMVELAAKRGATAIYLHAFLDGRDTPPRSAESSLKRFTAKFAELGNGRIASIIGRYYAMDRDNRWDRVQLAYDLLTQAKGEFTADNAVAGLQAAYARGENDEFVKPTVIQATGEADAAMNEGDTLIFMNFRADRARQITRTFVNAEFDGFKRDKVVNFGDFIMLTEYAADIKVACAYPPASLTNTFGEWLMKHDKTQLRISETEKYAHVTFFYNGGVEEPFKGEDRILINSPKVATYDLQPEMSSAELTEKLVSAIGSGKYDVIICNYPNGDMVGHTGDYDAAVKAVETLDNCIEQVVAAVKAADGQLLITADHGNAEQMRDPATGQAHTAHTSLPVPLIYVGNKAVKAVEGGKLSDIAPTMLSLMEMEIPQEMTGKPLFIVE

SEQ ID NO: 18447 - protein, 98 aa, Glycine max
MAWRGNLLKNIKELRFLMCQSSPASSPTRAFVERNYKELKTLNPKLPILIRECSGVEPQLWARYDLGVEKGIKLEGLSEAQIFKALEDLVKAGQSMKA

SEQ ID NO: 18448 - protein, 545 aa, Haloarcula marismortui ATCC 43049
MAQTVHRTDDVHPLIEPIADHVLSTERHENAPAAVIRADEVQTVLSTLRTEAGLDHCACVTAQEYADRFETIYHLRRYADPTQELSVVVPTARESPTSESAVPVYPTAAWHEREAYDLVGIEYEDHPDLRRILLPETWQGHPLSRDYNQDQPQIVSFREHERLLEDHRAGPETMHINMGPHHPSTHGVLHLNVQLDGEQVAAVDPDIGYIHRCEEQMCQQGTYRHQIMPYPDRWDWGGAGLLNEWAYARAAEALADIEVPAYAQVIRTMGGELSRILSHMLAVATYALDVVGEFTATFQWGVRDRELVQDILEDLTGQRLMFNYLRLGGVAWDLPEPREAFFEKIRAFLDDLPHKLTEYHDMLTSNEILQLRTIDTGHLSAETAKAYGCTGPVARASGVDYDLRRDDPYGYYDELDWSVVTEQGGDNFSRLLVRLREVEESAKIIGQCVDLLEDWPEDDREIQANVPRTLRPDPDTEIYRAVEAAKGELGIYIRSDGTETPARFKIRGPSFSHVQALSEMARGEYVPDLVATIGSLDTIMGEVDR

SEQ ID NO: 18449 - protein, 358 aa, Glycine max
MACLLRARNPCYSLMRRIRIRCMSNVPENTVYSGPTSQSSTKRVTLSQLRQKHRASQPITMVTAYDYPAAVHLDTAGVDICLVGDSAAMVVHGHDTTLPITLEEMLVHCRAVARGAKTPLLVGDLAFGTYESSSNQAVDTAVRMLKEGGMDAIKLEGGSPSRIVAAKAIVEAGIAVMGHVGLTPQAISVLGGFRPQGKNVASAVKVVETALALQEAGCFSVVLECVPAPVAAATTATLQIPTIGIGAGPFCSGQVLVYHDLLGMLQHPHHAKVTPKFCKQYARVGDVINKALLEYKEDVINGSFPDAHHSPYKISKTDADVFSTELQRLGLDKAASAASEAVQKMDTTKSTSEGKQTK

SEQ ID NO: 18450 - protein, 428 aa, Staphylococcus aureus subsp. aureus MRSA252
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGDDIAGVIVEPVAGNMGVVPPIEGFLQGLRDITTEYGALLIFDEVMTGFRVGYHCAQGHFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFEQANKSDLKLFAEMYREMAKEGVFLPPSQFEGTFLSTAHTKEDIEKTIQAFDTALSRIVK

SEQ ID NO: 18451 - protein, 212 aa, Zea mays
  misc_feature (183)..(183): Xaa can be any naturally occurring amino acid
  unsure (1)..(212): unsure at all Xaa locations
MASLSLSSPPSLSSAHHNASTRLILRTPNSLKLRTPPHSLPAIRAITLTQDDLKRLAADKAVESVKSGMVLGLGTGSTAAFVVAKLGALLASGQLSDIVGVPTSKRTEEQARSLGIPLSVLDDNPRLDLAIDGADEVDPDLNLVKGRGGALLREKMVEAASDKFVVVVDDTKLVDGLGGSGLXMAVEGVQFCWKYNLDRLQELFREEVWKQN

SEQ ID NO: 18452 - protein, 309 aa, Glycine max
APPPELTRAEFVEAQEALVQMKNWFMRFPTILQACECIFEMLRGQYAHSVGCYHEAAFHFIEAVKLTDSKSMQAMCQVYAAVSYICIGDAESSSQALDLIGPVYGVMDSFVGVREKTGVLFAYGLLLMKQQDLQEARNRLARGLQLTHTYLGNLQFVSQYLTILGSLALALHDTVQAREILRSSLTLAKKLYDIPTQIWVLSVLTALYKELGERGNEMENAEYQNKKLEDLQRRLANAHASIYHIEIIDKVRLEVHQLNDLDIKRAMADPTMGVNLDIPESIGLSAPLSAPSSSRLVDIDTRRRGKRRI

SEQ ID NO: 18453 - protein, 632 aa, Oryza sativa
MAVSLWRAVMGAAGGGGSSSSSAAGGDAGGGVEFWHGGERTGWLNKQGEYIKTWRRRWFVLKQGRLFWFKDAAVTRGSVPRGVIPVATCLAVKGAEDVINRQFAFELSTPTDTMYFIADSEKEKEEWINSIGRSIVQHSRSVTDAEVVDYDSRPNSKPPPQPKTSEESEPSAGILGGSSLAIHVSITPSSPLKFEFLDLVFFNFVPYHSLWSSMGIKTVFSMENLPQWKTRKLGPLGLKFHYVKAGKHPEKVELTCLANARSTSRLAPAGTVRAAVAAYGRGAGKGKGKRRVVGAFHAPPGRRRTALVAALPEPLQPLSPAQDGAVALASTEADGGEEVHGDVASAEISSPSGVLGKTVRVRFVLKRECTFGQSFHLVGDDPALGLWDPSKAVPLDWSEGHDWTVEKDLPANKLIEYKFVLQDLSGKLHWQNGRNRSVQTGETANILVVYEDWGNANSQTVEEEGKVSIGMEEGKLSVGMEEAVVPDDSESRDDIIVADELQVDDNLAVMQNESSVREDDKKSTVGTVTSVQAELMKLHEANQPELIVDEPQIQEALPETADTEPENGGVATCADDRYAESTDDDGVPVGGTDDDGVPVENRWTGAFEHELLWGWKALQQLLMSLGFKMDTS

SEQ ID NO: 18454 - protein, 541 aa, Arabidopsis thaliana
MGFFSTILGFCGFGVGISLGLVIGYVLFVYLLPNDVKDPEIRSIADQDPKAMLRMLPEIPLWVKNPDFDRVDWINRFLEYMWPYLDKAICKTAKNIAKPIIEEQIPKYKIDSVEFETLTLGSLPPTFQGMKVYLTDEKELIMEPCLKWAANPNILVAIKAFGLKATVQVVDLQVFAQPRITLKPLVPSFPCFANIYVSLMEKPHVDFGLKLGGADLMSIPGLYRFVQEQIKDQVANMYLWPKTLVVPILDPAKAFRRPVGIVHVKVVRAVGLRKKDLMGGADPFVKIKLSEDKIPSKKTTVKHKNLNPEWNEEFKFSVRDPQTQVLEFSVYDWEQVGNPEKMGMNVLALKEMVPDEHKAFTLELRKTLDGGEDGQPPDKYRGKLEVELLYKPFTEEEMPKGFEETQAVQKAPEGTPAAGGMLVVIVHSAEDVEGKHHTNPYVRIYFKGEERKTKHVKKNRDPRWNEEFTFMLEEPPVREKLHVEVLSTSSRIGLLHPKETLGYVDIPVVDVVNNKRMNQKFHLIDSKNGKIQIELEWRTAS

SEQ ID NO: 18455 - protein, 86 aa, Brassica napus
MVSKESCRNEIRAAIRQLSDRCLYSAAKWAGEQLVGIEQDPSNFTPSNTRFQRGSSSIRRRFSTISTPQPSAGFSQPPATPLPQEE

SEQ ID NO: 18456 - protein, 335 aa, Gibberella zeae PH-1
MPNSMALTPYGSNGSTDLTMAVLGCGTMGVAILSGILNSLAEMQGPKPLQTLTSSPGDEVPDRLPSRFVASVATPAGAKRVKGALWEHSSILKVVHNDNIGAVQQSEVVILACKPWMVKEILTEPGISKALHGKLLISVCAGITVEDIEIALHGAVPCKDPEEDGRCRIVRAMCNTAAVIRESMTVIASPNSPLDHATESLVTWIFKRIGDVVYLPTRHMDASTALCASGPAFFALVLEAAIDGAVAMGIPRPDAQRMATQSMRGTAGLVQNGEHPALLREKVCTSGGCTIGGVLVLEEGKVRGTVSRAVREAAVVAGQIGKGADGVNGTRFHYE

SEQ ID NO: 18457 - protein, 859 aa, Saccharomyces cerevisiae
MTYKYNCCDDGSGTTVGSVVRFDNVTLLIDPGWNPSKVSYEQCIKYWEKVIPEIDVIILSQPTIECLGAHSLLYYNFTSHFISRIQVYATLPVINLGRVSTIDSYASAGVIGPYDTNKLDLEDIEISFDHIVPLKYSQLVDLRSRYDGLTLLAYNAGVCPGGSIWCISTYSEKLVYAKRWNHTRDNILNAASILDATGKPLSTLMRPSAIITTLDRFGSSQPFKKRSKIFKDTLKKGLSSDGSVIIPVDMSGKFLDLFTQVHELLFESTKINAHTQVPVLILSYARGRTLTYAKSMLEWLSPSLLKTWENRNNTSPFEIGSRIKIIAPNELSKYPGSKICFVSEVGALINEVIIKVGNSEKTTLILTKPSFECASSLDKILEIVEQDERNWKTFPEDGKSFLCDNYISIDTIKEEPLSKEETEAFKVQLKEKKRDRNKKILLVKRESKKLANGNAIIDDTNGERAMRNQDILVENVNGVPPIDHIMGGDEDDDEEEENDNLLNLLKDNSEKSAAKKNTEVPVDIIIQPSAASKHKMFPFNPAKIKKDDYGTVVDFTMFLPDDSDNVNQNSRKRPLKDGAKTTSPVNEEDNKNEEEDGYNMSDPISKRSKHRASRYSGFSGTGEAENFDNLDYLKIDKTLSKRTISTVNVQLKCSVVILNLQSLVDQRSASIIWPSLKSRKIVLSAPKQIQNEEITAKLIKKNIEVVNMPLNKIVEFSTTIKTLDISIDSNLDNLLKWQRISDSYTVATVVGRLVKESLPQVNNHQKTASRSKLVLKPLHGSSRSHKTGALSIGDVRLAQLKKLLTEKNYIAEFKGEGTLVINEKVAVRKINDAETIIDGTPSELFDTVKKLVTDMLAKI

SEQ ID NO: 18458 - protein, 327 aa, Gibberella zeae PH-1
MSFNPNNDIPDLSGKVIIVTGASSGLGKESALQLAKHNPATIFVTARTEKRGNAAIKEIQDAVPNFKGQIKFLELDLSSFASIQKGATAFLNQSDRLDILMNNAGLMATPAGLTTDGYEVQFGSNYMGPALFTKLLLPTIVRTAQQQGDARVINLSSELFKQAPKEGVLLSRVKTPLEDISSLARYGQSKLADYYHTRSLSKYYPSVKFVAIHPGVVNTGLFDDLRKRRPWLGGLIGVMGSIFLTDVHAGAKAQLWASTAKSESVRSGGFYNQKLKEYKDAVLDDEKAVEELWDWTEKEFAIIITSIQQKRKVIVEVGYAKLPLQLS

SEQ ID NO: 18459 - protein, 272 aa, Lactococcus lactis subsp. cremoris
MKLNNQIEIPELGLGVFQIPNEETAEVVKNGIINGYRLIDTAKIYENEEGTGQGIKEGLASTGLTREDLFVTSKLWGDNHSYKETIQSFEESLKKLDLDYLDLYLIHWPGTNYAYKEAWKAMEDLYKAGKVKAIGVSNFQKHHLEELLSYAEINPVLNQIELHPKLSQKELREFLKLHDIKVQAWSPLMQGQLLDNEMLKKIADKHGKSVAQIILRWDIQQEILVNVKSIKSERMIANRQIFDFALDQEDMEALNSLNEALRVGPNPDTFNF

SEQ ID NO: 18460 - protein, 248 aa, Triticum aestivum
  misc_feature (217)..(217): Xaa can be any naturally occurring amino acid
  unsure (1)..(248): unsure at all Xaa locations
MSSSSKLFQSACKAARSFLASSSAPAAAPRAASSVLADGRNAALATLANLGRNSTLPAAYAHHLHTNAASSQGYAWIAAIPAAVYMLQDQEVHAAEMERTFIAIKPDGVQRGLISEIVSRSERKGYKLVAIKLVVPSKQFAEKHYHDLKERPFFNGLCDFLSSGPVLAMVWEGEGVIKYGRKLIGATDPSKSEPGTIRGDLAVVVGRNIIHGSDGPXETAKDEIALWFQPKELVSYTSNEEKWIYGVN

SEQ ID NO: 18461 - protein, 228 aa, uncultured cyanobacterium
HEVAGAGQHELGMKFAELIQAVDNVMTYKYVVRNVAKKYGKTATFMPKPVFNDNGTGMHVHQSLWKGGQPLFFGEGTYANLSQTARWYIGGILKHAPSFLAFTNPTTNSYKRLVPGFEAPVNLVYSEDNRSAAVRIPLTGPSPKAKRLEFRSGDALANPYLAFSAMMMAGFDGIKNQIDPGDGVDVDLFELPADELAQIATVPASLNGALEALNADKHYLMEGGVFSE

SEQ ID NO: 18462 - protein, 478 aa, Medicago truncatula
MGFRNNAIQAGSLDVGGKSKGKMKKDCDEKEIGCCVKFSCFGKCIPSRLKVDSSKSGTTSAHNVENASAYERSKKDRSAPPGSSTTSNAESIPSTPMFSEELKVSSDLRKFTFNELKMATRNFRPESLLGEGGFGCVFKGWIEENGTAPVKPGTGLTVAVKTLNHDGLQGHKEWLAELNILGDIVHPNLVKLIGFCIEDDQRLLVYQFMPRGSLENHLFRKGSLPLPWSIRMKIALGAAKGLNFLHEEAQRPIIYRDFKTSNILLDAEYNAKLSDFGLAKDGPQGENTHISTRVMGTYGYAAPEYVMTGHLTSKSDVYSFGVVLLEMLTGRRAVDKNRPNGEHNLVEWARPVLGERRLLFQIIDPRLEGHFSVKGAQKSAQLAAQCLNRDPKARPMMSEVVQALKPLQNLKDMAIASYHFQVVRVDRTMSMPNSKNGTQTQVASLSKKGQPMRILSSPNGQHGSPYRHYIKSPKPKNG

SEQ ID NO: 18463 - protein, 228 aa, uncultured cyanobacterium
HHEVATAQHELGMKFAELIQAADNVMIYKYVVRNVAKKYGKTATFMPKPIFADNGSGMHVHQSLWKAGQPLFFAPGTYANLSDTARWYIGGILKHAPSFLAFTNPTTNSYKCLVPGFEAPVNLVYSEGNRSAAVRIPLTGPSPKAKRLEFRSGDALANPYLAFSAMMMAGIDGIKNQIDPGAGVDVDLFELPADELAKIATVPASLNGALEALRADHHYLLEGGVFTK

SEQ ID NO: 18464 - protein, 362 aa, Aspergillus nidulans FGSC A4
MPGQTLPTFTPAEVESHNSAKSCYVTIGSKVYDITSFVDDHPGGGDLVLEYAGKDVTEILRDPVSHTHSESAYEILEDNLVGFIGSESSSKCANGSANGKPVYASTGMSTAEDLSVETDAVQDYQKHKFLDLNKPLLMQLWNSGFSKEFYLEQVHRPRHYKGGDSAPLFGNFLEPLSKTAWYVVPIVWLPPVLYGTYLGASGLGRAPAAAAYWLFGFFLWSLIEYLMHRYLPDNRVGITLHFLLHGIHHYLPMDKYRLVMPPSLFVILATPFWKLAHTVFYYNWNAAVLAYCGGVFGYICYDLTHYFLHHRNLPSYYKGLKKYHLEHHFADYDNGFGVTSRFWDWVFGTELELPPPKVLKTQ

SEQ ID NO: 18465 - protein, 338 aa, Synechococcus sp. RS9917
MTTPRFSNHDCSLDVVGIGNAIVDVLVQTDDSFLETHGLNKGAMALVDENQAHALYEASGSGLETSGGSAANTLAGLAQLGSRAGFIGRVRNDQLGEIFSHDIRAVGTRFDTPAAIDGPSTARCLILVTPDAQRTMCTYLGASVQLEPEDLDLSMVRDTKVLYLEGYLWDSPAAKRAFISAAETCRQSGGQVALSLSDGFCVDRHRDSFLELVNGHVDVLFANESEITSLYGTDDFDHAIAQVKGCCHVAALTRSEKGSVVLSGDQRWDVPAYKLGDLIDTTGAGDLYAGGFLHGYTQGLDLETCGRIGSLCAGQVVTQLGPRSQVSLQTLVREHLGS

SEQ ID NO: 18466 - protein, 338 aa, Streptomyces coelicolor A3(2)
MGESVLLTSTPPEHKESVIVSSAPQSRPWDVHRLPSAEGRNFLVTGGNAGIGYFTAEQLAATGALVVIGSRNPAKADAALASIRSRVPGARVRHLHLDLADLSTLKSAVDGLALDLGRLDAVVHNAGGALDDPPRRETEDGHELMFGTNHLGHYALTRWLAPLLSAAPAGRVVTVGSFAARSERLDLDDLQSTRDYRPKRTYGRSKLAQMCFGFELDRRLRAAGSTVLSAVAHPGGALDSLTPPRPPVGAPTPGERLRGLPAALMVQGKDAGAWPVVRAVLDSDVQGGQLWGPRVFGLRGQPRREPVPAHMADPAVAARLWAASAELTGTTDPHLGFR

SEQ ID NO: 18467 - protein, 639 aa, Candida glabrata CBS 138
MELSNELIRDVRWNLRKAALEMSMMKLNGSSKWAAEALNGICEEVTVDQLGLESPMDKLGKHIEIKEPGNSKISGDIPNKNFLSFHDNKSNFYFNEKEYDKYLYVSTMFDNKEFDRCAFYLEDATNPSLKFLKLYSMYLSWDKKTQESLENVLTIEKNSVKYDNAGNRNLNIDAADDFSSFGGLKKKSIDDPHNKNDQSGVTEILNELDQYLEDVQSHKVPKNSLGYALLFYLRGILLKESNSKSMAIRAYLRSLRIYSFNYSCWSDLLECITTVEESQMLLSHFMSNFQFENLENINSQSKLESNIPFKIFQLLLFKEFQGNVDEYLTTFEDLLTLFPNFTFLQAQKALTSYQYMDYVNSEQIFEKIMEDDPYRLDDMDTFSNILYVMQKNAKLAYLAQFVSQIDRFRPETCCVIANYYSARQEHEKSIMYFRRALTLDKKTTSAWTLMGHEFVELKNSNAAIESYRRAVDIDPRDFRAWYGLGQAYEVLDMHLYSLYYFQRACILKPLDKRMWQALGSCYAKVGNHAEAIKCYERALQLTTQSEQDTALLYKLALLFEQTNGIDKCKLLMEKCVEIERITEGLVTDESVKARLWLAKFELKTNNYVKAYDLAVGVSNGTSQEMEEARSIARECRRKM

SEQ ID NO: 18468 - protein, 370 aa, Pseudomonas fluorescens PfO-1
MIKSRAAVAFEAKKPLEIVEVDVAMPKAGEVLLRVVASGVCHTDAYTLSGADPEGIFPSILGHEGGAIVEAIGEGVTSVAVGDHVIPLYTPECGQCKFCKSGKTNLCQAIRATQGKGLMPDGTSRFSYKGQTIFHYMGTSTFSEYTVLPEISVAKISKDAPLEKVCLLGCGVTTGIGAVINTAKVKPGDTVAIFGLGGIGLSAVIGAVKAKASRIIAIDINPAKFEIAKQLGATDCVNPKDFDRPIQEVIVDMTDGGVDFSFECIGNVQLMRAALECCHKGWGESVIIGVAGAGQEISTRPFQLVTGRVWRGSAFGGVRGRTELPSYVDMAQSGEIPLDTFITHTMGLEDINKAFDLMHEGKSIRTVIHF

SEQ ID NO: 18469 - protein, 230 aa, Lactobacillus johnsonii NCC 533
MSKLVLIRHGQSEWNLSNQFTGWVDVNLSEKGVEEAKKAGRLIKEHGLEFDQAYTSLLTRAIKTLHYALEESDQLWIPETKTWRLNERHYGALQGLNKKDTAEKYGDEQVHIWRRSYDVLPPAIDDDNEYSQAHDRRYANLDPHIVPKAENLHVTLDRVMPFWEDHIAPDLLDGKNVIIAAHGNSLRALTKYIENISDDDIMDLEMKTGEPVVYTFDDKLDVVNKEKLDD

SEQ ID NO: 18470 - protein, 369 aa, Pseudomonas syringae pv. tomato str. DC3000
MAFDRIEDIIEDYRQGKMVLLVDDEDRENEGDLLLAADCCTAQAISFMAREARGLICLTLTDEHCKSLGLEQMVPSNGSVFATAFTVSIEATTGVTTGISAADRARTVQAAVNPGAVPDDLVQPGHIFPLRARDGGVLTRAGHTEAGCDLARMAGFTPASVIVEVMNDDGTMARRPDLELFAEKHGIRIGTIADLIHYRLSTEHTIVRIGERELPTVHGTFRLFSYEDRIEGGVHMAMVMGDIRREDPTLVRVHVVDPLRDLVGAEYTGPANWTLWAALQRVAEEGCGVVVVLANHESSQALLERIPQLTQPPRQYTRSQSRIYSEVGTGAQILQDLGIGKLRHLGPPLKYAGLTGYDLEVIESIPFPG

SEQ ID NO: 18471 - protein, 470 aa, Pseudomonas fluorescens Pf-5
MADAGTVLQRGLSTRHIRFIALGSAIGTGLFYGSAAAIQRAGPSVLLAYLIGGAAIYLTMRALGEMAVRTPVSGSFGHYASSYLGRFAGFLTGWSYAFSMLMVCLADVTAFGVYMGLWFPDTPRWIWVLSIVLGIGALNLCSVKVFGELEFWLSLLKVGAIVAMIVGGFTLLFFGIQLGEEQSRGGLANLWEYGGFFPNGVEGMIASFTIVMFAFGGIEVIGITAGEAKDPQRMIPKAINSVPLRILIFYVLTLLILLTLAPWSSIGSHGSPFVQIFSSLGISSAATVLNIVVISAVVSAINSDIFSAGRMMYGMAAIGQAPAVFARTSRFGVPWMTVLVMSVALLLGVLLNYWIPQELFLIFASLVTFSVVWVWLMILLSQMAMRRGMSAREIHELKFPLPLGTAGQACAVVFMLFIFGVLGAFADTRLALYVGLGWLALLSLAYWIWIKPDTTGSAAAESGIGTQEKG

SEQ ID NO: 18472 - protein, 256 aa, Exiguobacterium sibiricum 255-15
MNILMVGAGSMSESLVKGWLDSGISPQMITMTNRADRSRLFALAEQYGVRTTAEEQVDQFDVVVLAMQPDGVLDYIKQQTWRTDQLVVSVAAHITPAEIEAHISCGAVCAMPNTPVAFRTGMTGLWFGDLVSDEKRQQATALFGRVGETVETNAATMPYLMAAAGCSPAFFYEIVGAMTPVLTKAGFDASSARRIIAQAMKGSAELLLHEERPTEELIKDVAAPGGPTDRGVRVLREHDLAQAMYEALMESAREKN

SEQ ID NO: 18473 - protein, 154 aa, Glycine max
MDGSKAKKVAAKKFGGPRKKSVTKSIKAGLQFPVGRIGRYLKKGRYAQRVGSGAPVYLAAVLEYLAAEVLELAGNAAKDNKKTRIVPRHLLLAIRNDQELGRLLSGVTIAHGGVIPNINPVLLPKKAAEKTEKVGAAPKSPKKTAKSPKKATKA

SEQ ID NO: 18474 - protein, 497 aa, Staphylococcus aureus subsp. aureus MRSA252
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVVTVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGGNDVATSPFTLVFKNAGFAFAASFMNAVILTSVLSAGNSGMYASTRMLYSMSKDKLAFETFGKTNKNGVPYMSLLVTAIIVVIIFVVQSVTEGAYQYIVAASGLTGFIAWVGIAVSHYRFRRAFDKQNYDKSKLKYTAKWFPFGPIFAAILCIVVIIGQDVDFIKTGDFNFSRFLITYMGIPVFLAFFIYHKLRYKTKKIPLEQVDLRQDVSMDEIKG

SEQ ID NO: 18475 - protein, 440 aa, Zea mays
MESQNTCEEVLPVSTLSEPLLPGKADDDDDLEVQLTPYDRRATATATGASSFSRTCLNLTNAVSGIGVLSMPYAVAQGGWLSLALFALVGAVCYYTGTLIERCMRADPGAIASYPDIGKFAFGSAGRRAVAFFMYVELYLVAISFLVLEGDNLDKLFPGSSVRLAGDYRLQGKQLFIALAAAVVLPTTWLKSLGVLAYVSAVGLVASAVLTASLVWAGVSETGFRRNSTSVLSLSGLPTSLGLYFVCFTGHAVFPTIYSSMRNNRHFSKVLLISSVLCSVNYGLTAVLGYMIYGEDVQSQVTLNLPSGKLYTKVAIVTTLINPLAKYALLVAPITAAVEERFYLPAGSAPARVSVSTVVVVSTAVVASTVPFFGYLMSFIGSFLSVMATVIFPCLCFLKIYRAEGISRIEVAAIAGILMMGVFVAVTGTYTSLQQIIGSL

SEQ ID NO: 18476 - protein, 91 aa, Arabidopsis thaliana
  misc_feature (33)..(33): Xaa can be any naturally occurring amino acid
  misc_feature (48)..(48): Xaa can be any naturally occurring amino acid
  misc_feature (50)..(50): Xaa can be any naturally occurring amino acid
  misc_feature (62)..(62): Xaa can be any naturally occurring amino acid
  misc_feature (68)..(68): Xaa can be any naturally occurring amino acid
  misc_feature (70)..(70): Xaa can be any naturally occurring amino acid
  misc_feature (75)..(75): Xaa can be any naturally occurring amino acid
  misc_feature (78)..(78): Xaa can be any naturally occurring amino acid
  misc_feature (83)..(83): Xaa can be any naturally occurring amino acid
  unsure (1)..(91): unsure at all Xaa locations
MASSMFSSTAVVTSPAQATMVAPFTGLKSSASXPVTRKANNDITSITXNXGRVSCMKVLPPXGKKKFXTXFLLPXLSXGEFAXESTFFLNK

SEQ ID NO: 18477 - protein, 481 aa, Saccharophagus degradans 2-40
MKIHNMKNFINGEYIASQADGAIDVLSPSTGKKVGDIPAGCVEDAQLALDTANAAQKLWAKKTNRERAKILRVFAANIRAAADDLAKLLVSEQGKLLSVAQMEVEATATFIEYACDNALTIEGDILPSDNPNEKIYIHKVPRGVVVAITAWNFPLALAGRKIGPALVTGNAIVVKPTQETPLATLALGELANAAGIPAGVLNIVNGRGSVVGQHLCESPITRLITMTGSTPAGQRIYRTSADHLTPVMLELGGKAPFIVMEDANLESAVEAAFTTRYANCGQVCTCAERLYVHESIYPAFMDKLLEKVKAIKVGDPMAADTDMGPKVNQSEIENIDALVKKGIEQGATLLHGGKRAHVPGFEGGNWYEPTLLGDVQQSNILVHEETFGPILPVVKINSIEQAIEYTNDSEYGLSTYLFTQNLKYIHQYIAEVEAGEVYVNRGIGEQHQGFHNGWKLSGAGGEDGRYGLEQYLEKKTVYFAE

SEQ ID NO: 18478 - protein, 385 aa, Bacillus cereus G9241
MEQFINPRVKDIQISGIRQFSNMIQNYDNLISLTIGQPDFPTPSLVKEAAKRAITENYTSYTHNAGLLELRKAACNFVKDNYDLHYSPENETIVTIGASEAIDVAFRTILEPGTEVILPAPIYPGYEPIIRLCGATPIFIDVRETGFRLTAEALEKAITEKTRCVVLPYPSNPTGVTLSKEELQDIVDVLKDKNIFVLSDEIYSELVYEQTHTSIAHFPEMREKTIVINGLSKSHSMTGWRIGLLFAPRYLAGHILKVHQYNVTCATSIAQYAAIEALTAAKDAPKMMRHQYKKRRDYVYNRLIQMGLTVEKPTGAFYLFPYVGHLTSSSFDFALDLVKEAGLAVVPGTAFSEYGEGYLRLSYAYSIETLKEGCDRLEAFLQQKS

SEQ ID NO: 18479 - protein, 329 aa, Burkholderia pseudomallei K96243
MHAWSAQHVPPQGGKVAVVTGANSGLGWQIAQTLAAKGAQVVMGCRDTAKGELAAHAIRTRYPRARIEVEALDLADLASVCRFADAVADRHGRVDILCNNAGVMFLPLRHTRDGFEMQMGTNHLGHFALTGLLLPALRASHRARVVTMSSGFNRLGKIRLDNMLAERGYNKYRAYCDSKLANLMFTLELQRRFDQACLPILSVAAHPGYAATHLQFAGPEMANSSLGTFAMRLSNRLVAQSADVGALPAIHAATAVDVDGGAYIGPAHLCETRGYPAEARIPRQARDVRMGKRLWEKSEQLTGVRYLDTPPPPGSRRRASRDDATFGAL

SEQ ID NO: 18480 - protein, 536 aa, Saccharophagus degradans 2-40
MGVSSRTAFQFAAIVAMGGFIFGLDAALISGTVRFVTAEFGLNDLQLGSVVSAPGFGVLFALIAAGPLCDRIGRKYTLIIIAALYVLSAVFSVIAPSYEALVAARFIGGLAFASLSLASMYIGEIAPADMRGKLVSMNQITIVVGLTAAYFFNYFLLELAGSGAQWVQTVGLQQNLWRWMLGVEILPALVWLLLLLRIPESPRWLIAKNRIDDAKHALQRLVPAEKVEENLASICNAVHGEVLAPSFAKQFSMLFDSRLKRAMIVGLAFAIVQPITGVNAILFYAPMVFEQTGVGTNAAFMQTIIVGLVSLVFTVVALSCIDKFGRRPLVIVGLLWSVLSLFMCFWAFNEATYLLEASHLAELAGTLDQAQLGALQNMIGVQYSSDLEYKAALALNLGAESARAYEGVLIQLAATMNGWLVILGIIGFIAAFHLSIGPIMWVVFSEIVPIHVRGVAIPMFAFVTSLVSFFVQKLFPWQLNVMGAAEIFLFYCLSGAAGLVLLWWFLPETKGKTIEQIADGLAGEQPASSRVSTSAS

SEQ ID NO: 18481 - protein, 369 aa, Thermoplasma acidophilum
MVMAEWTEVNFGPQHPSMHGVLRLRVKLDGEIVKEVEPIIGYLHRNAEKIGELQFYCDNMIYFDRMDYVAAMNMEVGYLEAAEKLLDIEVPERAQWIRVMMAELNRIASHLVWLGAFGLDLGMLTPFFYCFKEREKILKIFTEVSGSRQQLNYMSIGGVYQDVTDEALDHIKTFIREFPKELNKIESLFVKNDVFISRTKGIGILSKEMAIDYGVTGPMLRASGVEYDVRKAQPYLVYDKVNFDIPVSFKGDNLARFLVRVEEMRQSVKIVEQTIQKLPAGPYFNQKAKKPLMIRLRGQGEVYARTESPKGEFGVYLIGDGSLRPYRVRVRSPTFKNLSVLPALAKDQMIADLISIGGSIDLVFGEVDR

SEQ ID NO: 18482 - protein, 269 aa, Saccharomyces cerevisiae
MSNNKIKRKDASPEQEAIESFTSLTKCDPKVSRKYLQRNHWNINYALNDYYDKEIGTFTDEVSTVAHPPVYPKELTQVFEHYINNNLFDIDSLVKFIEELGYNLEDLATLCLAHLLGYKKLEEPLKREDFLSTWFMQGCSTISDMQECIKTLDVKLHEDLQYFTQIYNYAFNLILDPNRKDIDTDEGIQYWKLFFQPEYPVRMEPDLLEAWFRFLRDEGKTTISKDTWRMLLLFFKRYPTIQKIISDYDETAAWPFIIDEFYECLQDQQ

SEQ ID NO: 18483 - protein, 579 aa, Methylococcus capsulatus str. Bath
MAEHLYPGFFSELLVLLLASLASVLLFQRLRLPDILAYLFAGGLVGPFGFGMVTNDANIHFLSELGLVFLMFELGLEFSVRQLLHLSRAVFGLGSLQMLLTLSVFASALFFALHWPIGATLVVAGSLALSSTALVVRELRSLKLINRHHAQLAVGVLIFQDLAALLGLILVPALAGNGERALHEQLLHVAEKGGILVVILTGAGKWLLPSIFHEVARSRSEEIFVLTVLVIILLSAWLTQAFGLSMALGAFLTGVMLGEGEFRHQVEVDIRPFKDILMGVFFASVGMQIDFGLLVEEGRIVLLGIVLLILAKSVVITLAARIMGESATTGSKTGIILAQASEFGLALITLGAQLGVLAPRIASLALAIVVGSLILAPWLIRYNFEISQWIGRLVGQKVSGRDREMSRIPPHLSDHIILAGYGRVGQMIAKFLKNNGIPFIALDPDGNRIKEGRAAGDPVIYGSCARIDLLRRCHMERARLAILTFKSLSEARRIITQIRRQGYTLPIVVRTQNEADHAELIAAGADYVIPEMLESSLVIAAEVLSLLGYSKTVVQPQIDAERALHAQIKEPAAPDPGEG

SEQ ID NO: 18484 - protein, 152 aa, Escherichia coli
DLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 18485 - protein, 178 aa, Glycine max
MLLDKNDTQETHYEVLNVKEDANYEEIRASYRSAVLSLHPDKLLKTSETSSSNQTAEERFLKVQKAWEILSNSSSRSFYDNDLRSSRQDVLAADVAEDLSLQDMMIEDDGEALELFYQCRCGDYFSVDSLELKNMGYSLLREGSGISIMNVDTSPGSVILPCGSCSLKARLLINMDVN

SEQ ID NO: 18486 - protein, 301 aa, Agrobacterium tumefaciens str. C58
MTKWTEANIPNQRGRSAVVTGTGGLGLETALALARAGCDVTIAGRNPEKGSDAVSRIQRAAPHVTVSFEKLDLADLTSIALFAQRMENDRESLDLLVNNAGIMVPPKRQETRDGFELQFGTNYLGHFALTAHLMPLLKKGTDARVVTVSSVAARAGKINFADINSEKNYHPMRAYSQSKLACLMFALELQDRSRAAGWGVSSIAAHPGVSRTDLLHNAPGRNSLQGLARTFLWFLFQPVAQGALPQLFSATSKEVKSGGYYGPDRLGETRGHPQPARIPPEALDRVAGKQLWEISQRMTGL

SEQ ID NO: 18487 - protein, 379 aa, Pseudomonas syringae pv. tomato str. DC3000
MKAIVYNGPRDVSVKNVPDAKIEKPTDALVRVTTTNICGSDLHMYEGRTSFETGRIFGHENMGEVIEVGAGVDRVKVGDRVCLPFNIGCGFCENCEKGLTGYCLTANPGSAGAAYGFAEMGSHEGGQAELLRVPYADFNCLLLPEDAAEREDDYVMLSDIFPTGWHATELAGLLPGESVAIYGAGPVGLMAVHSAMIKGASQVFVVDNHPDRLALAAKMGATPINSLEQGAVDQILNLTDGRGTDRGCECVGYQCCDRHGHEANHVTMNNLVASTKATGGIGVVGVFVPQDPGAHSDLAKEGKMAFDFGSFWFKGQQIRTGQANVKAYNRRLAELIHHDRAKPSQIISHRLKLEEGPAAYQHFDARDDGWTKVVLKPNG

SEQ ID NO: 18488 - protein, 355 aa, Oryza sativa
  misc_feature (104)..(104): Xaa can be any naturally occurring amino acid
  unsure (1)..(355): unsure at all Xaa locations
MGAPATAASGGGDDDDRDVVFEYLLCTEEDAASAGSFFQQLQGPAPAVSSSPSTTTATAPAAAGSCDDGGEEEEEEVWTVDVVAELIGGEAERSHSPRADYPGXRLRSGRPADLAARADSVAWILKVRELYGMLPVTAYLAVSYMDRFLSLHRLPGNGWAMQLLAVTCLSLAAKMEETLVPSILDLQMEDARYIFEHRTIFRMELLVLDALDWRLRSITPFTFMYLFADKVDPNGKHIRELIHQATQVTLATIHDTEFLDHCPSSIAAAAVLCASSEIMQLVSIDHGTLVSWRIIGLDEEAIIRCYRLMQQLISSNNVGRESTEITMATTTTTATTAVSSEEVVSSSPPSKRRKM

SEQ ID NO: 18489 - protein, 72 aa, Triticum aestivum
  misc_feature (22)..(22): Xaa can be any naturally occurring amino acid
  unsure (1)..(72): unsure at all Xaa locations
FRAAAREFVKKNYGDIKTRNPXLPVLIRECSGVEPQLWARYDMGVERCVRLDGLTEAQIDKKLEELAKAGVA

SEQ ID NO: 18490 - protein, 476 aa, Pseudomonas syringae pv. tomato str. DC3000
MYPDVQLYIDGQWRASRDGRSIPVIDPATGQSLGSVAHAGIADLDEALSAAERGFATWRATSAYDRYKLMQKAADLVRERADSIARIMTQEQGKPLAEARMETLSAADVIDWLAEEGRRSYGRIVPSRGVSIEQKVIKEPVGPVAAFTPWNFPINQVVRKLSSALAAGCSIIVKAPEETPGSPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLQAFTEKFVGLTREIKVGNGLESGTTMGPVANDRRIPALVDLIEDAVSAGATVSAGGKAVEGQGYFFEPTVLSGLTPAMRIMNEEPFGPVALLVPFDTVEEAIVESNRVPFGLASYAFTTSMKTAQALSTYIEAGMLSINHQGIGLPEVPFGGIKDSGYGSEGGTEAIEAYLNTKLVTQYS

SEQ ID NO: 18491 - protein, 640 aa, Haloarcula marismortui ATCC 43049
MSSADETLDRIKAQVEEETPDDIEIESVAFEGPELVIYTPDAQTVANRDGIVRNLAQTLRKRINVRPTQEALVPPNEARAQITQTIPEDAGVQNLDFDRQTGEVFIEAEKPGRVIGRHGATLDEISASVGWTPEVVRTPPMESSTVSNVRNYLKQEREERRDILQRVGRQINRPTTSDEDWVRLTTLGCCREVGRAAFILSTPESRILIDCGDKPGAEGEVPYLQAPEALAAGPNSLDAVVLTHAHLDHSALIPILFKYGYDGPIYTTAPTRDLMGLLQLDYLDVASKEGRTPPYESQQVRDALKHTIPLEFGNVTDIAPDIKLTMHNAGHILGSAVCHFHIGEGRYNVAFSGDIHYKDTRLLDGAVNDFPRVETLVLESTYGGKNDYQTDQSDSERVLRDVINESYENDGKVLIPAFAVGRSQELMLVLEEAMRKGDIPTMPVYLDGMIREATAIHTAYPEYLRDDLRQRILYEDENPFLAEQFEQVDGGDEMRQDIADDEPAIILTTSGMVTGGPVMSWLRLLGSDPDSTMAFVGYQAEGTLGRQIQRGQDEITLGDTSGPRAERVSLRLNVETVDGFSGHADRQGLESFVETMHPRPEKILCVHGDASTTNQLSSALYQKFNMRTHNPKNLETFRLS

SEQ ID NO: 18492 - protein, 436 aa, Vibrio angustum S14
MSKTSKSADLFAKAKQKIPGGVNSPVRAFAGVGGTPLFIERADGAYIFDADGNAYIDFVGSWGPMILGHNHAAIRDAVIDAAQQGLSFGAPTAMEITMADLVSKLVPSMEMVRMVSSGTEATMSAIRLARGFTSRDKILKFEGCYHGHADCLLVKAGSGALTLGQPSSPGVPADFAKHTLTATYNDLDSVREAFATHPEEIACIIVEPVAGNMNCIPPVPGFLEGLRDICDEFGTLLILDEVMTGFRVSEGGAQGYYNIKPDLTTLGKIIGGGMPVGAFGGRREVMEFVAPTGPVYQAGTLSGNPVAMAAGHACLSVLTEDGNEKRLANTTKRLADGFKALADKHGVPLAVNQVGAMFGFFFTEQETVTCYEDVTKCDVERFKRFFNLMLEKGVYLAPSAYEACFTSLAHTDQVIDATLEAADFAFATLAHENSPE

SEQ ID NO: 18493 - protein, 93 aa, Arabidopsis thaliana
GPWAPSRLSSVPRVAFPVKAIMAAPLNGLKSSVAFPATRRVTTDITSITGNGGGVNCMQVGPPMGRKKLGTFFYLPDLTDSEWVKEVASLIRT

SEQ ID NO: 18494 - protein, 161 aa, Brassica napus
  misc_feature (2)..(2): Xaa can be any naturally occurring amino acid
  misc_feature (20)..(20): Xaa can be any naturally occurring amino acid
  misc_feature (24)..(24): Xaa can be any naturally occurring amino acid
  misc_feature (26)..(26): Xaa can be any naturally occurring amino acid
  misc_feature (30)..(30): Xaa can be any naturally occurring amino acid
  misc_feature (33)..(33): Xaa can be any naturally occurring amino acid
  misc_feature (36)..(36): Xaa can be any naturally occurring amino acid
  misc_feature (38)..(38): Xaa can be any naturally occurring amino acid
  misc_feature (42)..(42): Xaa can be any naturally occurring amino acid
  misc_feature (48)..(52): Xaa can be any naturally occurring amino acid
  misc_feature (54)..(54): Xaa can be any naturally occurring amino acid
  misc_feature (58)..(58): Xaa can be any naturally occurring amino acid
  misc_feature (60)..(63): Xaa can be any naturally occurring amino acid
  misc_feature (78)..(78): Xaa can be any naturally occurring amino acid
  misc_feature (80)..(80): Xaa can be any naturally occurring amino acid
  misc_feature (86)..(86): Xaa can be any naturally occurring amino acid
  misc_feature (92)..(95): Xaa can be any naturally occurring amino acid
  misc_feature (99)..(99): Xaa can be any naturally occurring amino acid
  misc_feature (104)..(105): Xaa can be any naturally occurring amino acid
  misc_feature (109)..(109): Xaa can be any naturally occurring amino acid
  misc_feature (121)..(121): Xaa can be any naturally occurring amino acid
  misc_feature (123)..(124): Xaa can be any naturally occurring amino acid
  misc_feature (127)..(127): Xaa can be any naturally occurring amino acid
  misc_feature (129)..(129): Xaa can be any naturally occurring amino acid
  misc_feature (131)..(134): Xaa can be any naturally occurring amino acid
  misc_feature (143)..(145): Xaa can be any naturally occurring amino acid
  misc_feature (148)..(148): Xaa can be any naturally occurring amino acid
  misc_feature (150)..(150): Xaa can be any naturally occurring amino acid
  misc_feature (152)..(152): Xaa can be any naturally occurring amino acid
  misc_feature (155)..(156): Xaa can be any naturally occurring amino acid
  misc_feature (160)..(160): Xaa can be any naturally occurring amino acid
  unsure (1)..(161): unsure at all Xaa locations
MXSSMLFLRCVSPTSPGHAXMVAXFXGLKXSAXFPXTXLADXDITSIXXXXXRXSCMXVXXXXGKKKFETLSYLPDLXEXELTEEXEYLLRXXXXPCVXFELQXXFVYXEHVCTPGYDDGXYXXRWXVXLXXXXDSARVMKEXXXVKXGXPXAFXXIIGXD

SEQ ID NO: 18495 - protein, 260 aa, Glycine max
MEQAGKQGIMVASQSQNPIEQIQARFKDLETGFRLWLSKQSLPVEAAVVTTTSAAQGAAIGAFMGTLTADASSTFPTPPPNASLNPQAMASLKQAQALAGGPLIQARNFAVMTGVNAGISCVLKRIRGKEDVQSSMAAAFGSGALFSLVSGMGGPNQATNALTSGLFFALVQGGLFQIGQKFSQPPAEDTHYAKTRHMLNNLGLQSYEKNFKKGLLTDNTLPLLTDSALRDVRIPPGPRLLILDHIQRDADLKDKRGSRK

SEQ ID NO: 18496 - protein, 721 aa, Glycine max
RVRIIRNDVSYPVKFYGKVVSGSDGKKHWIGGEDIKAVAHDVPIPGYKTKTTINLRLWSTKAASEEFDLSAFNAGRHTEASEALANAEKICYILYPGDESIEGKILRLKQQYTLCSASLQDIIARFERRSGTNVNWEEFPEKVAVQMNDTHPTLCIPELMRILIDVKGLSWKDAWNITQRTVAYTNHTVLPEALEKWSLDLMQKLLPRHIEIIEMIDEELIRTIIAEYGTENSDLLEKKLKEMRILENVELPAEFADIVVKSKEAIDIPSEELQSSEQAEVEERKDDEVEAVAKKNGTDESSIEDEKEELPEPVPEPPKLVRMANLCVVGGHAVNGVAEIHSEIVKDEVFNAFYKLWPEKFQNKTNGVTPRRWIRFCNPDLSKIITEWIGTEDWVLNTGKLAELRKFVDNEDLQVQWREAKRSNKVKVAAFIREKTGYSVSPDAMFDIQVKRIHEYKRQLLNIFGIVYRYKKMKEMSAAERKANFVPRVCIFGGKAFATYVQAKRIVKFITDVGATVNHDPEIGDLLKVVFVPDYNVSVAEMLIPASELSQHISTAGMEASGTSNMKFAMNGCILIGTLDGANVEIREEVGADNFFLFGAKAHEIAGLRKERAEGKFVPDPRFEEVKEFVRSGVFGSYNYDELMGSLEGNEGFGRADYFLVGKDFPSYIECQEKVDEAYRNQTKWTRMSILNTAGSYKFSSDRTIHEYAREIWNIEPVQLP

SEQ ID NO: 18497 - protein, 180 aa, Brassica napus
  misc_feature (149)..(149): Xaa can be any naturally occurring amino acid
  misc_feature (154)..(154): Xaa can be any naturally occurring amino acid
  unsure (1)..(180): unsure at all Xaa locations
MGKSGKKPRESHRQGRGRRASHFCDEDGYDLPSSAYDATPRQNEESSEDNDDTSDATAEDEPERDTEAGEQDQWQGSMPSKFHLYQLSVQSPKGDISYLQKFFLMYVGGRAPLHLQEDFCGTALLSTEWIRTDARRTAIGLDLDLESLXEWCLXETTLSKIGADGYSRMLLFHGNVLQPM

SEQ ID NO: 18498 - protein, 453 aa, Staphylococcus aureus subsp. aureus MRSA252
MAEKLQRELSNRHIQLIAIGGAIGTGLFLGAGQTIALTGPSILLTYIIIGFMLFMFMRGLGEIIIQNTEFKSFADVTNTYIGPFAGFVTGWTYWFCWIITGMAEVTAVAKYVSFWFPEIPNWISALFCVLLLMSFNLLSARLFGELEFWFSIIKIATIIGLIVVGFVMILFAYKTQFGHASFTNLYEHGVFPKGASGFFMSFQMALFSFVGIEMIGVTAGETKDPVKTIPKAINSVPIRILIFYVGALAVIMSIIPWQQVDPDNSPFVKLFALIGIPFAAGLINFVVLTAAASSCNSGIFSNSRMLFGLSSQQQAPPNFSKTNKYGVPHVAIFASSALLLVAALLNYIFPDATKVFTYVTTISTVLFLVVWGLIIIAYINYSRKTPDLHKKATYKLFGGKYMGYLIFVFFIFVFGLLFINVETRRAIYFIPIWFILLGFMYLRYKRIAAKSNN

SEQ ID NO: 18499 - protein, 585 aa, Staphylococcus aureus subsp. aureus MRSA252
MRKTKIVCTIGPASESEEMIEKLINAGMNVARLNFSHGSHEEHKGRIDTIRKVAKRLDKIVAILLDTKGPEIRTHNMKDGIIELERGNEVIVSMNEVEGTPEKFSVTYENLINDVQVGSYILLDDGLIELQVKDIDHAKKEVKCDILNSGELKNKKGVNLPGVRVSLPGITEKDAEDIRFGIKENVDFIAASFVRRPSDVLEIREILEEQKANISVFPKIENQEGIDNIEEILEVSDGLMVARGDMGVEIPPEKVPMVQKDLIRQCNKLGKPVITATQMLDSMQRNPRATRAEASDVANAIYDGTDAVMLSGETAAGLYPEEAVKTMRNIAVSAEAAQDYKKLLSDRTKLVETSLVNAIGISVAHTALNLNVKAIVAATESGSTARTISKYRPHSDIIAVTPSEETARQCSIVWGVQPVVKKGRKSTDALLNNAVATAVETGRVTNGDLIIITAGVPTGETGTTNMMKIHLVGDEIANGQGIGRGSVVGTTLVAETVKDLEGKDLSDKVIVTNSIDETFVPYVEKALGLITEENGITSPSAIVGLEKGIPTVVGVEKAVKNISNNVLVTIDAAQGKIFEGYANVL

SEQ ID NO: 18500 - protein, 251 aa, Pseudomonas syringae pv. syringae B728a
MRRPMVAGNWKMHGTRASVAELIEGLCKQSLPGSVDIAVMPASLFTCQVVDGLKATSIIVGAQDAAIQAEQGALTGEVASSQLADAGCKLVLVGHSERRQLIGEQDDVLNKKFAAIQAKGLTPVLCVGETLEERKAGQTLEVVGRQLDSVIAEFGVNALVNAVIAYEPVWAIGTGLTASPQEAQEVHAAIRAQLAKENAEVAQGVRLLYGGSVKAANAVELFSMPDIDGGLIGGASLNADEFGAICRAAGN

SEQ ID NO: 18501 - protein, 180 aa, Zea mays
MARRGTEAFPNLGAHCDKPDCNQLDFLPFDCDGCGKVFCAAHRTYGDHGCAKAADQGRTVVVCPDCGDAIERLVPGQGEREILEAHVRSRRCDPGKKRKPRCPARRCREQLTFSNTQDCKGCGRKVCLKHRFPADHDCAASAPGAAAAARRASGECGRGARKEGSGGWALPASIRSLKIF

SEQ ID NO: 18502 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFSAFRPPGCE

SEQ ID NO: 18503 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYSDAYVRVIGFDNLRQVQCVSFIAFRPPGCE

SEQ ID NO: 18504 - protein, 182 aa, Solanum tuberosum
MKKSQKSLLIKIIVVQCLLVLCVAAQDFDFFYFVQQWPASYCDTRRSCCYPTTGKPDEDFSIHGLWPNYENGKWPQNCDKESSLDESEFSDLISTMEKNWPSLACPSSDGLKFWSHEWLKHGTCSALNQHAYFQTALDFKTKSNLLQNLNNAGIKPRNGEHYSVESIKNAIEEGVGHTPFIE

SEQ ID NO: 18505 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 18506 - protein, 340 aa, Xanthomonas campestris pv. vesicatoria str. 85-10
MKALVKREANKGIWLEQVPVPTPGPNEVLIKLEKTAICGTDLHIYLWDEWSQRTIRPGLTIGHEFVGRVAELGSAVTGYQVGQRVSAEGHIVCGHCRNCRGGRPHLCPNTVGIGVNVNGAFAEYMVMPASNLWLIPDQIPSELAAFFDPYGNAAHCALEFDVIGEDVLITGAGPIGIIAAGICKHIGARNVVVTDVNDFRLKLAADMGATRVVNVSKTSLKDVMADLHMEGFDVGLEMSGNPRAFNDMLDCMYHGGKIAMLGIMPRGAGCDWDKIIFKGLTVQGIYGRKMYETWYKMTQLVLSGFPLHKVLTHQLPIDDFQKGFDLMEEGKAGKVVLSWN

SEQ ID NO: 18507 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGWE

SEQ ID NO: 18508 - protein, 417 aa, Arabidopsis thaliana
MKLRFSGDLSRLQSDKWKLGASVRKREREREGSFVFQMSAILAAAIGGAVGALALIALFVFLLWFCVFRRKNLSRTSETGSSDPSTQEGRNVAIELSMREARRFEMEELAQATKSFTNKSLIGIGKFGGVYKGLLQDGVLVAIKKRPGLPTQEFVNEVRYLSSIHHRNLVTLLGFCQESNTQFLVYEYVPNGSVSSHLYGAGGKVPGNRLEFRHRLAISIGAAKGLAHLHSLSPRLIHKDFKTANVLVDENFIAKVADAGVRNFLGREDVGTSSHIVADQIFLSPEVQEFKRFSEKSDVYAFGVFLLELVSGREASEPSPSSSTQTLVDWMQNLTDYADIPMMIDERLGGTYTAEGVEELITLTLRCVDVSSEKRPTMSFVVTELERILDKEVSLTTVMGEGTPTVTLGSQLFKATK

SEQ ID NO: 18509 - protein, 320 aa, Haloarcula marismortui ATCC 43049
MERVVASDDPMIDVDRLRAELDADVVVAETDDEDAVRDAAAGAAGLVVDVNTPVTAGVLDALDDLKIVARAGVGIDNIDVSAAADNGVTVTNVPEYCTDEVATHTVTLLLDCVRTLTAYDRDVRDGGWGWERTRPVHRVRDQTLGLVSFGPIARRVRDQLRGFDLDVIAYDPYVDAEEMADADVEKVALETLYERADYVSLHAPLTGETAEMIDADALAAMREQAILVNTGRGGLVDEAALRTALEDGMIGAAGLDVLAEEPPTAEHPLVGLDNCIVTPHAAWYSEEARDDLNAAVAANVEAALAGETPPNRIDPDTDWL

SEQ ID NO: 18510 - protein, 528 aa, Synechococcus sp. CC9605
MTKVLVSDPIDQAGVDILDQVAQVDQRTGLSEEELIGIIGEYDGLMIRSGTQVTAAVIAAASRLKIIGRAGVGVDNVDVPAATQRGVLVVNSPEGNTIAAAEHALAMMLTLSRHIPQAHGGMRAGKWDRKKFVGNELYKKTLGVVGLGKIGSHVARVAQAMGMEVIAYDPFIAADRAQRMQVKLLELDELFRTADYVTLHIPRTKDTENLVNAELLRTMKPTARIVNCARGGVVDEAAIAEAINNGVIAGAGLDVYASEPLAEDSPLRAVERGLVLTPHLGASTEEAQENVAIDVAEQIRDVLLGLPARSAVNIPGLSAEIMERLKPHLQLAETVGLLVSQLAGGHVQEMELRLQGEFASHPSQPLVIAALKGLLSAGLGDSINFVNASLEAKARGIQVLEVKDESSRDFAGGSLQITTRGDQGSRSVTGAVFADGDLRITSIDAFPVNVTPSSHMLFTRHRDMPGIIGHLGSLLGEHNVNIASMQVGRKIVRGDAVMVLSIDDPIPADLLQTITAIDGIQEAHPVTL

SEQ ID NO: 18511 - protein, 55 aa, Glycine max
QAQRANALAAAQGLADKVSFQVADALQQPFSDGQFDLVWSMESGEHMPDKAKVLN

SEQ ID NO: 18512 - protein, 143 aa, Photobacterium sp. SKA34
MTIERTFSIVKPDAVKRNLIGAIYQRFENAGLNIVAAKMLHLDSAKAQGFYAEHEGKPFFDDLVAFMTSGPVMVQVLEGENAITRYRELMGKTNPEEAACGTIRSDFALSMRHNSVHGSDSPESAAREIAYFFAEDEIYPQGE

SEQ ID NO: 18513 - protein, 892 aa, Candida albicans SC5314
MASSETLHTSNTSDSHITQKKTGFFNKLIKKSKDSKGSSKTLTQSELKSISSASRRSSIKNGKRDSIYSKQFVDDDNSSLYNDDMDDSTSIIDDETDDSMFETVDNSDSPASFEKIVTGNNSTFDNHTLSEKVMFPASTEGLDMDIPIDQEPPYVGLTYESFLSPKYVKTTRRNKQSPRVVNNLFLAQELNVNETAVNSGDAEAETEDEHDGLSHDEDFGGDTRREIFVMEFSKDGKYLAAAGRDSVIRIWKVISSPLARMEFNQLEKENGQPLRSNKRDSVFDTAPVFHRQPVREFRGHSSSVLSLAWSKNNFLITGSMDKTVKLWHVDRDRCLQTFEHEDFVTSVKFHPSDDRFFLSGSLDNGVRLWSVLENSVSYSKNLGDEVLITALEFSPDGLHCFVGGFNGSLFILETKGLFEVFRVEIKERSIVHPFVNKNGNKITGIKVFDNNLYQGSGVPGQLDKWTVLVTTNDSKVRIITTTQKRLITRFRGLTNNSSSIVAHSSDDQKYIISGSEDHYCYIWENNNSIINNKLKQSLKEFMIDGKQHISDFHHKHEKYSKFVSLNKFLNKFLEEDKDRKYDFVANENNSYTCFHAHHSRCNVAIFAPESTKKHLLLSDDLIYDLKRRGESCRISPSSCFTCNSKNHKLEDTVQSGDIIVTTDQFGLIRVFRQDCAYAYRRMFIDFYRKGQIKNCNDIQSITQSEKTLPIRRALTRRDRSTSRIRAPSLSPVRQSENSKSIRNILASKINSSVPSTPSSETSFSSTIGSSSIDTRHYPGVAVLPKNPMLSISAAARNPSFMQPGVSVPIDHDNVVEADRTGSDTTLGAESGTQTPQPTLNQDDMQSSRTSTVPQIVFSKESESPDATNNNHHSQLEGVKINSQSQSRGRTKS

SEQ ID NO: 18514 - protein, 209 aa, Glycine max
MASKLTLIALVLAVALCAVDLTHSASASSPHAPAPSVDCTNLVLTMADCLSFVTNGSTVTKPEGTCCSGLKSVLKTAPACLCEAFKSSAQFGVVLNVTKATSLPAACKVSAPSATNCGCQSITITTKLSSFVFNVFMMLLSPSIRCFSLMINLRSSSENLINFSGVLLLFFILESRSCLRKLNLESSISRSFQRLVGACENVYGSSLLF

SEQ ID NO: 18515 - protein, 325 aa, Ensifer adhaerens
IGGWKAINESDMVLMPDPETAHMDPFFAQSTMVIICDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPIDSCQDMRSEMLTVLAEMGVTVEKHHHEVAAAQHELGVKFDALVRNADKMQIYKYVVHQVANAYGKTATFMPKPIFGDNGSGMHVHLSIWKDGKPTFAGDEYAGLSETCLYFIGGIIKHAKSLNAFTNPSTNSYKRLVPGYEAPVLLAYSARNRSASCRIPFGTNPKAKRVEVRFPDPTANPYLAFAAMLMAGL

SEQ ID NO: 18516 - protein, 536 aa, Streptococcus mutans
MQKHWWHKATVYQIYPKSFMDTNGDGIGDLKGITSKLDYLQKLGVMAIWLSPVYDSPMDDNGYDIANYEAIADIFGNMADMDNLLTQAKMRDIKIIMDLVVNHTSDEHTWFIEAREHPDSSERDYYIWCDQPNDLESIFGGSAWQYDDKSDQYYLHFFSKKQPDLNWENANLRQKIYDMMNFWIDKGIGGFRMDVIDMIGKIPAQHIVSNGPKLHAYLKEMNAASFGQHDLLTVGETWGATPEIAKQYSNPVNHELSMIFQFEHIGLQHKPEAPKWDYVKELNVPALKTIFNKWQTELELGQGWNSLFWNNHDLPRVLSIWGNTGKYREKSAKALAILLHLMRGTPYIYQGEEIGMTNYPFKDLNELDDIESLNYAKEAFTNGKSMETIMDSIRMIGRDNARTPMQWDASQNAGFSTADKTWLPVNPNYKDINVQAALKNSNSIFYTYQQLIQLRKENDWLVDADFELLPTADKVFAYLRKVREERYLIVVNVSDQEEVLEIDVDKQETLISNTNESAALANHKLQPWDAFCIKIN

SEQ ID NO: 18517 - protein, 92 aa, Brassica napus
MVTKEQVEASLTSKLKPIHLEVNDISGGCGSSFEVEVVSEQFEGKRLLERHRMVNAALEEEMKEIHALSIKKAQTPQQWKPSQDSATQAKDA

SEQ ID NO: 18518 - protein, 524 aa, Caulobacter crescentus CB15
MNNVGRPTRPEAANDAANGHETLTGARGLLQDEALIFELDGWNKTGVDLPPVTAAPSSDLNGLLRDAPIGLPGLSEPETVRHYVRLSQKNHAIDLALYPLGSCTMKHNPRLNEKMARLPGFSDIHPLQPQSTVQGALELMDRLAHWLKTLTGMPAVALTPKAGAHGELCGLLAIRAAHEAAGNGHRKTVLAPTSAHGTNPATAAFVGYTVVEIAQTEDGRVDLADLESKLGDHVAAIMVTNPNTCGLFERDVVEIARLTHAAGAYFYCDGANFNAIVGRVRPGDLGVDAMHINLHKTFSTPHGGGGPGAGPVVLSEALAPFAPTPWLTHGDNGFELAEHAGDDDAKTAFGRMSAFHGQMGMYVRAYAYMLSHGADGLRQVAEDAVLNANYIKAQLKDVMSPAFPEGPCMHEALFDDSWLEGTGVTTLDFAKAMIDEGFHPMTMYFPLVVHGAMLIEPTETESKHELDRFIAALRALAGAAKAGDTERFKGAPFHAPLRRLDETQAARKPRLRWKPVAAAPLAAE

SEQ ID NO: 18519 - protein, 351 aa, Clostridium beijerinckii
MKGFAMLGINKLGWIEKERPVAGSYDAIVRPLAVSPCTSDIHTVFEGALGDRKNMILGHEAVGEVVEVGSEVKDFKPGDRVIVPCTTPDWRSLEVQAGFQQHSNGMLAGWKFSNFKDGVFGEYFHVNDADMNLAILPKDMPLENAVMITDMMTTGFHGAELADIEMGSSVVVIGIGAVGLMGIAGAKLRGAGRIIGVGSRPICVEAAKFYGATDILNYKNGHIEDQVMKLTNGKGVDRVIMAGGGSETLSQAVKMVKPGGIISNINYHGSGDALLIPRVEWGCGMAHKTIKGGLCPGGRLRAERLRDMVVYNRVDLSKLVTHVYHGFDHIEEALLLMKDKPKDLIKAVVIL

SEQ ID NO: 18520 - protein, 448 aa, Caulobacter crescentus CB15
MRYLPLTPEDRVEMLGAIGVKSIDDLFVDVPVSARRDAPVDLPHHAGELDVEREMAGLARRNRAAGEGPFFCGAGAYRHHVPATVDHIIQRSEFLTSYTPYQPEIAQGTLQVLFEFQTQVAALTGMEVANASLYDGSTGAAEAVMMAQRVTRRNKAVMSGGVHPHYVGAIETLAHAAGVATQALPAAVDAEDAVIAAIDQDTACVVVQTPNVFGTVTDVSKIAEAAHAAGALLIVVTTEAVSFGLLKSPGEMGADIAVAEGQSIGNGLNFGGPYVGLFACKEKFVRQMPGRLCGETVDADGKRGFVLTLSTREQHIRRDKATSNICTNSGLCALAFSIHMSLLGETGLRQLAAVNHQKALALRDALKAVPGVEILTPRFFNEFAIRVPGKAAEVVEILAAHGVIAGVPFSRLDAKAGLDDVLLVAATETTLDIDIPVFAKALTKVFAQ

SEQ ID NO: 18521 - protein, 325 aa, Ensifer adhaerens
IGGWKAINESDMVLMPDPETAHMDPFFAQSTMVIICDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPIDSCQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKSLNAFTNPSTNSYKRLVPGYEAPVLLAYSARNRSASCRIPFGTNPKAKRVEVRFPDPTANPYLAFAAMLMAGL

SEQ ID NO: 18522 - protein, 406 aa, Myxococcus xanthus DK 1622
MKAVVFHGIGDIRLDDVEEPRIEKSTDAIVRLTASAICGTDLHMIRGTMPGMKPGTILGHEGVGVIEALGDDVRNLNIGDRVVIPSTIACGNCSYCRAGYHAQCNDANPNGPSAGTAFFGGPQETGPFHGMQAEKVRVPFANVGLVRIPEGVSDEQAILISDIFPTGYMGAELAEIKPGDTVAVFGCGPVGLFAIVSAKLLGAGRVFAIDCHEDRLDLARAQGAEVINFEEEDPLETLKRLTNGIGVDRAIDAVGVDAMHPHHGPAAKKAHQEKAEFKREVKEAAPKTNPKGDNWVPGDAPAQALMWAVEGLAKAGTLSIIGVYPAQVRTFPIGMAMNKNLTMKMGNCNHRKYIPKLLELVRTGVVDPTAILSHVEPMGSAIDAYRNFDARKPGWVKVELEPTQLQ

SEQ ID NO: 18523 - protein, 469 aa, Methylobacterium extorquens
MPARIQPVILCGGSGTRLWPTSRTSLPKQFVPLLGPHSTFQQTLLRLQGPLFARPIVVANRDHRCLVEKQAAAIDAGVTLLLEPERRDSGPAILAACTLVAREDPEAVVLVLPSDHIVTEPRAFRRAVASALPAARAGRLVTFGIEADHASTEYGWIRPGTRVEARCHAVHTFAEKPDAARAATYLSDRWLWNSGNFLMRADTLCAEYAAFDPDTAAAAALAVEAAADEGGALALDAEGFAGTHKTSLDFAVMEKTSRAAVARMRCGWSDVGNWNALWAISERDDLGNVSRGAAELFDTEGCFVSSDGMVTSLVGVRDLVVVAEKDAILVADRSRCGDVRKMVEILRSKGRPQAEWHASSHRPWGSYRVLEASDGFQVKRITVAPGGRLSLQKHRHRAEHWVVVRGCARVTVDDTVADYRESEHIFIPLGAIHRLENPGNDDVELIEVQLGSYLGEDDIVRLEDAYHRA

SEQ ID NO: 18524 - protein, 194 aa, Medicago sativa
MASASASLFKSSIVLDKSEWVKGQTLRQSSVSSVRCNPTAPSSLTIRAGSYADELVKTAKTIASPGRGILAMDESNATCGKRLASIGLENTEVNRQAWRTLLVTVPSLGEYISGAILFEETLYQSTTDGRKIVDVLIEQNIVPGIKVWTRVWCPLLVPMDESWCPGLDGLASRSAAYYQQGARFAKWRTVVSIP

SEQ ID NO: 18525 - protein, 136 aa, Triticum aestivum
  misc_feature (45)..(45): Xaa can be any naturally occurring amino acid
  misc_feature (50)..(50): Xaa can be any naturally occurring amino acid
  misc_feature (78)..(78): Xaa can be any naturally occurring amino acid
  misc_feature (91)..(91): Xaa can be any naturally occurring amino acid
  misc_feature (105)..(105): Xaa can be any naturally occurring amino acid
  unsure (1)..(136): unsure at all Xaa locations
FYLKGMKFMNVERSFAQQHYADLSDKPFFPGLVEYIISGPVVAMXGEGKXVVLTGRRIIGATRPWEAAPGTIRGDYAXEVGRNVIHGSDSXENGKKEIALWFPEXVAQWKSNLHPWDLRSLSSLWMPCLLQWKPFV

SEQ ID NO: 18526 - protein, 493 aa, Zea mays
  misc_feature (415)..(415): Xaa can be any naturally occurring amino acid
  unsure (1)..(493): unsure at all Xaa locations
MGSDADMEDYGFEYSDEEPEEQDVDIENQYYNSKGLVETDPEGALAGFDQVVSMEPEKAEWGFKALKQTVKLYYKLGKYKEMMDAYREMLTYIKSAVTRNYSEKCINNIMDFVSGSASQNFTLLQEFYQTTLKALEEAKNERLWFKTNLKLCKIWFDIGEYGRMSKILKELHKSCQREDGSDDQKKGTQLLEVYAIEIQMYTETKNNKKLKELYQRALSIKSAIPHPRIMGIIRECGGKMHMAERQWAEAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNFPEKDVEQLLVSLILDNRIQGHIDQVNKLLERGERSKGMXEVQCYRQVEYSAEVHLPNIVQQSLMRRIAAAAACIAHLALLIACFADLRATAKNCLVTLAIESWIWVKLILTTRSSLN

SEQ ID NO: 18527 - protein, 402 aa, Debaryomyces hansenii CBS767
MSYYNRNSSSSSSVLPSSRKTHSEKHKQILKQLLKEHANKTCVDCKTATHPRWASWSLGCFMCIRCSGIHRSMGTHISKVKSVDLDAWTDEQVELMIKWGNEKCNIYWESKLPDGYVPDQLKIDNFIRTKYDLKKWVSSTTIPNPLSIKASGSQNAGLTTAQHTSESHKSKNSDLGSADLLSGHSSKIEPHGSLLDDDFGSFTSSPSPKASTPVTSTRNTTALKSNQQRSNSTTQQKLPTENTSDGAGIQSAQSTGGSFSNTRPDLKKSILSLYSSPKSSSSSFIQPQHNSQAQPNMQASVNSLSNSLSGLDFNNSNTSTNFNVSSIPSRTSLASQSASQQPHARPEAQTTNWNNEWTDANESTASLNNQWPNSGSSGTHGAKTTSLNSTNLDDDLFKNVWS

SEQ ID NO: 18528 - protein, 388 aa, Saccharophagus degradans 2-40
MEGGVFESFFLIFCGAAVVASVALYTRQPLLVAYIAVGAILGPFGLEIIKDVHYVAEMSHIGIIFLLFLLGLDMQPSALLNVLKKATSIALISSAIFGALGYGFGVIIGFSHMESLVLAMASMFSSTIIGIKLLPTTVLHHKHSGDLMVGLLLFQDFIAILCLLVLLSGGGDTVEPMKLIKAIAALPLLAAGAFLFVRFVLLKLIQKFDRFHEYIFLLAIGWCLGLAHLSESVNLSAEIGAFIAGISLATSPISQYIALNLRPLRDFFLVLFFFALGAQLNIPLLPSVLLPALIFAAVVLAAKPTVFFLLLKQQSEKTSLAWDLGFRLGQISEFSILIVFVAATNNLIGEQASLLIQTTAILTFIVSSYIVIFNFPNPIAVSDKLRRD

SEQ ID NO: 18529 - protein, 545 aa, Synechococcus sp. CC9605
MNVGKSITNVSGRTGTVAPVVLAILDGWGYRNASEHNAIQQGGTPVMDALWHTYPHTLIEASGSHVGLPDQQMGNSEVGHLTIGAGRIIRQELVRISDTVRSNQLGETQALKELVERTQKRGGTLHLLGLCSDGGVHSHINHICGLIQWAADSGITDLAVHAITDGRDTPTQSAPGYISQVEAALSRSGVGQLASLCGRYWAMDRDQRWERIEKAYNLYTDPNFSVDNRTAGQVLTDSYAEEITDEFLEPVRLQNSVMKDGDSVLVFNFRPDRARQIVQALCLPDFDGFERSHTLELDVVTFTQVEQDLPVQVAFPPEPLDQLLGQVVADAGLKQYRTAETEKYPHVTYFMNGGIEQPLSGEDRHLVPSPRVATYDLSPAMSAEQLTDSCISAIERAEYSLIVINYANPDMVGHTGVMDAAKEAIQTVDCCIGRLLDAVGRQGGTMLITADHGNAELMQGADGQAWTAHTTNPVPAILIEGERRKLPGHGNSITLRDNGGLADIAPTLLQILDLPQPTAMTGESLIAPMSNMDPTPKTARLPLSV

SEQ ID NO: 18530 - protein, 104 aa, Zea mays
  misc_feature (62)..(62): Xaa can be any naturally occurring amino acid
  misc_feature (77)..(77): Xaa can be any naturally occurring amino acid
  unsure (1)..(104): unsure at all Xaa locations
MESTFIMIKPDGVQRGLIGEIISRFEKKGFYLKALKLVNVERFFAEMHYFHLVFKPFFQGLXVDYIIFVPVVAMVCXVKSCHSTGRTIIAATNSLAFEPVTNPC

SEQ ID NO: 18531 - protein, 784 aa, Arabidopsis thaliana
MEERRDDESSPTHQGSELAERVKLLSFESQGEALSKDSPRSVEQDCSPGQRASQHLWDTGILSEPIPNGFYSVVPFLKFEILLQDKRVKELYNRLPTPSELHALGEEGVRIEVILVDFQKDKKLAMLKQLITTLVSGSGTNPALVIKKIAGTVSDFYKRPTLESPSKLALEENAFLFENHGAQLLGQIKRGCCRARAILFKVLADTVGLESRLVVGLPSDGTVNCMDSNKHMSVIVVLNSVELLVDLIRFPGQLVPRSAKAIFMSHISPAGESDSAENDSCDSPLEPNSPLYERRDPESTEKDENLQFYRKLEGYPNASGSSLRSLMLRPSTAIERKLSNTSHSEPNVATVFWRRSRRKVIAEQRTASSSPEHPSMRRGRSMLSTGRNSFRDYTGEASSPSSSSTSEIRKTRRRSFRITPEIGDDIASAVREMYEKSKQNRLLQGREDENSSVIDNNVSGLHLDDELNSKKTMSLPSSPHAYRCQTFGRRGPSEFAVKDTWNKPVESSTLQNQPLLPYQEWDIDFSELTVGTRVGIGFFGEVFRGVWNGTDVAIKLFLEQDLTAENMEDFCNEISILSRVRHPNVVLFLGACTKPPRLSMITEYMELGSLYYLIHMSGQKKKLSWHRRLRMLRDICRGLMCIHRMKIVHRDLKSANCLVDKHWTVKICDFGLSRIMTDENMKDTSSAGTPEWMAPELIRNRPFTEKCDIFSLGVIMWELSTLRKPWEGVPPEKVVFAVAHEGSRLEIPDGPLSKLIADCWAEPEERPNCEEILRGLLDCEYTLC

SEQ ID NO: 18532 - protein, 260 aa, Zea mays
MPQGGYIELHQKRHGRRMDYEERKRKKEARAVKKNSKDARKLLGAKGKRFAKKRYAEKAQMKKTLKMHDESSSRQKVDDDVEEGAIPSYLLDRDPTQRAKVLSNTIKQKRKEKAGKWDVPLPKVRPVAEEEMFKVLRTGKRKTKQWKRMVTKATFVGAGFTRKPPKYERFIRPTGLRFTKAHVTHPELKCTFNLDIISVKKNPNGPMYTSLGVMTRGTIIEVNVSELGLVTPAGKVVWGKYAQVTNNPENDGCINAVLLV

SEQ ID NO: 18533 - protein, 248 aa, Clostridium perfringens ATCC 13124
MEKKVLATVGNTEITSDYIDEIIARYPAQQQAMLASDEGKRQVLEQAIAFELMSEFAKETGLDKTEEFKDQLNKFAKELLAQMVMKKTLSSVTVTDDEAKAFYEEHKENFVELETVTAKHILVASEEEAKKVEEEIASGSITFEDAANKYSSCPSKEQGGNLGSFSKGMMVPEFEEAAFNLELGVVSAPVKTQFGYHLIKVEDKTEAKTKAFEDVKEQVVNMLIQERQQKKYLELIKELREKYGVKLA

SEQ ID NO: 18534 - protein, 433 aa, Zea mays
SARECHSLERLEITGCPMITDKGLVAVAQGCPELKSLTIEACSGVANEGLKAIGRCCAKLQAVSVKNCAHVDDQGVSGLVCSATASLAKVRLQGLNITDASLAVIGYYGKSIKDLTLARLPAVGERGFWVMANALGLQKLRCMTVVSCPGLTDLALASVAKFSPSLKTVNLKKCSKVSDGCLKEFAESSRVLESLQIEECSKVTLVGILAFLLNCNPKFKALSLSKCIGIKDICSAPAQLPVCKSLRSLTIKDCPGFTDASLAVVGMICPQLESIDLSGLGAVTDNGFLPLMKGSESGLVSVGLNGCESLTDAAVSALAKAHGASLAHLSLEGCSKITDASLFAISESCSQLAELDLSNCMVSDYGVAVLAAARQLKLRVLSLSGCMKVTQKSVPFLGSMPSSLEALNLQFNFIGNHNIASLEKQLWRCDILA

SEQ ID NO: 18535 - protein, 586 aa, Schizosaccharomyces pombe
MITVRQFTFTIFKFQFMATSNVSSRVNELLEAVKKEFEDICQKTKTVEAQKDDFEYKAMISAQINEMALMKQTVMDLEMQQSKVKDRYEEEITSLKAQLEARRKEIASGVVPQSSKTKHGRNSVSFGKYGNAGPFNSDNSSKPLILNNGSSGGTPKNLRSPAIDSDGTVLAPIQTSNVDLGSQYYSSPHVRPAVGATMAGSAMRTFPSNLPLGHPPPPSDSANSSVTPIAAPLVVNGKVSGNPPYPAEIIPTSNVPNREEKDWTVTSNVPNKEPPISVQLLHTLEHTSVICYVRFSADGKFLATGCNRAAMVFNVETGKLITLLQEESSKREGDLYVRSVAFSPDGKYLATGVEDQQIRIWDIAQKRVYRLLTGHEQEIYSLDFSKDGKTLVSGSGDRTVCLWDVEAGEQKLILHTDDGVTTVMFSPDGQFIAAGSLDKVIRIWTSSGTLVEQLHGHEESVYSVAFSPDGKYLVSGSLDNTIKLWELQCVSNVAPSMYKEGGICKQTFTGHKDFILSVTVSPDGKWIISGSKDRTIQFWSPDSPHSQLTLQGHNNSVISVAVSPNGHCFATGSGDLRARIWSYEDL

SEQ ID NO: 18536 - protein, 140 aa, Rhodopseudomonas palustris CGA009
MAIERTFSILKPDATERNITGAINALIEKAGLRIVAQKRIRMTRDQAETFYAVHKERPFFGELVDFMISGPVVVQVLEGEGAIAKYRDVMGATDPSKAADGTIRKLHAKSIGENSVHGSDAAETAKIEIAQFFSGNEIVG

SEQ ID NO: 18537 - protein, 325 aa, Sinorhizobium terangae
ISGWKAINESDMVLMPDPETAHMDPFFAQSTMVILCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPIDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFPDPSANPYLAFAAMLMAGL

SEQ ID NO: 18538 - protein, 447 aa, Lyngbya majuscula
MKLPPGPQTPAILQMIEWVFHPSKLMQTCAQRYGDTFTVKVGPNLAPVVFLSDPKAIQKIFTADLKQFETGKLNKIAQPLIGEYSLMLQDGKYHQRQRRLLMPPFHGERMRRYNKIIDDIAKQVISQWPEGKPFSIRPSIGKISLELIVECVFGLRKGPRSQHLIQLLTLMAEYTSKPLAIALVSCKPMQRDFGSWSPWGSFIRLKQQITKLIYDEIGERRSQFDSSRTDILTLLMSARDEDGMPMTDVELHDQLITFLMGGHDTTTTALVWAFYWIHYLPEVREKLLRELDSLGDDLEESNIIKLRYLNAVCSETLRINPISVLTLFRSVKSPLQLMSYQYDPGTILAGCIYLTHRREDLYPEPEKFKPERFLERQFSFYEYLPFGGGNRRCVGDALAMFVMKRVIATVLREKQLTLVDRRPVKPVFRGPGLAPSGSMQMVAVTKK

SEQ ID NO: 18539 - protein, 550 aa, Coccidioides immitis RS
MAPLPVSFTCLRTLFVSLLLAPLVLSQWQSTLQKDPPAGEPKQIAIIGAGAGGSSAAYHLRKYADFFSIPINITVFERSNYVGGRSMTVDLFDDPAQPVELGASIFVKANSNLLKAAKKFGLKVKEADHDMPRDSVHSLGVWDGSRFVFLQRETNFRWWNIFQLLWKYGWAPMRTQSVMSATVDKFLKLYKWPYFPWKSLSAVAMSTGLVEATWSTGAEFLKENHITEEFAREVIQASTRVNYGQNLALIHGLETMVCMATDGAKSVEGGNWQIFQGMVDVSKAHLNLETTVQEVHRNDDDTYTLTYEMEGSDFSQYADFDQVVIASPLQFSGIKISPNLETLPDDTPYVDLHVTLLASPHKISPRFFRLPDNKASVPSVILTTLPHGLDLGARRDGVGPAGFWSISTIKKARPPTASYPSGDDHYVYKIFSPQPLSPQFISDLFDISEMDLYDDHNTTFHRSGSTIGGFSANEISWLHEKKWHSYPYLYPRATFEDIKLAPGLWYTSAIEHFISTMETSALSGMNIAALILSEWISEFEVKLKKYEESG

SEQ ID NO: 18540 - protein, 325 aa, Bradyrhizobium elkanii
IAGWKAINESDMCLMPDPVTATIDPFFAETTMVITCDVLEPTTGEPYNRDPRGIAKKAEAMVKSMGVGDTVFVGPEAEFFVFDDVRYSAEPYNTGFRLDSSELPINSATEYEGGNLGHRIRTKAGYFPVPPQDSVQDMRSEMLGAMAKMGVKVEKHHHEVASAQHELGMKFDTLTLMADQMQVYKYCIHQVAHIYGKTATFMPKPVYGDNGSGMHVHQSIWKDGKPTFAGNKYADLSETCLHYIGGIIKHAKAINAFTNPSTNSYKRLVPGYEAPVLLAYSARNRSASCRIPYTANPKAKRVEVRFPDPMANPYLGFAAMLMAGL

SEQ ID NO: 18541 - protein, 468 aa, Oceanospirillum sp. MED92
MSEKTLNLIKESNAKWIDLRFTDSHGKEQHVTIPVSDMGDDFFEEGKMFDGSSISGWKGINDSDMILMPDDSASLLDPFSEATTVIVRCNIVEPATGQGYERDPRSVAKRAEEYLKSTGIADTAMFGPEPEFFVFDEVKWHADISGCGYTIASEEASWASSHKIEGGNTGHRPRVKGGYFPVPPIDSLHDLRGAMCDAMEAMDLEIEVHHHEVATAGQCEIGVGANTLTAKADEVQVLKYCVHNVAHAYGKTATFMPKPLVGDNGSGMHVHMSLSKDGVNLFAGDAYAGMSETALYYIGGIIKHAKALNALTNSSTNAYKRLVPGFEAPVMLAYSARNRSASIRIPYVTSPKARRVEARFPDPSANPYLCFSALMMAGLDGIKNKIHPGDAADKDLYDLPAEEAAEIPQVASSLEEALNALEEDREFLTQGGVFTDDMLDAFIELKREEVEKVNMTTHPVEFDLYYSV

SEQ ID NO: 18542 - protein, 165 aa, Triticum timopheevii subsp. armeniacum
VMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 18543 - protein, 325 aa, Mesorhizobium loti
IAGWKAINESDMVLMPDPETVHMDPFFAQSTMVILCDILDPVSGESYNRDPRGTAKKAEAYMKAEGIGDTIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDALVRNADKMLIYKYVVHQVANAYGKTATFMPKPIFGDNGSGMHVHMSIWKNGKPTFAGNEYAGLSESCLFYIGGIIKHAKAINAFTNPLTNSYKRLVPGYEAPVLLAYSARNRSASCRIPFGSSPKAKRVEIRFPDPGANPYLGFAALLMAGL

SEQ ID NO: 18544 - protein, 122 aa, Brassica napus
LSYEDEFFGLEINSRNEIEDEEDEEEEEEEDRGGEMFPITTRSITGRNRILDWAEILMGIEDNSDRYAVNAADYVDDGAGYEALLQNLAEGDGGGRRGAPPAAKSAIEALETLEVGDSCDKM

SEQ ID NO: 18545 - protein, 323 aa, Mesorhizobium mediterraneum
GWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPDPGANPYLAFAAMLMAGL

SEQ ID NO: 18546 - protein, 165 aa, Triticum aestivum
VMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 18547 - protein, 325 aa, Bradyrhizobium japonicum
IAGWKAINESDMCLMPDPVTATIDPFFAETTMVITCDVLEPTTGEPYNRDPRGIAKKAEAMVKSMGVGDSVFVGPEAEFFVFDDVRFSSSPYNTGFRLDSSELPTNTDTEYEGGNLGHRIRTKAGYFPVPPQDSVQDMRSEMLGAMAKMGVKVEKHHHEVASAQHELGMKFDTLTLMADHLQIYKYCIHQVAHIYGKTATFMPKPVYGDNGSGMHVHQSIWKDGKPVFAGNKYADLSETCLHYIGGIIKHAKAINAFTNPSTNSYKRLVPGYEAPVLLAYSARNRSASCRIPYTASPKAKRVEVRFPDPLANPYLGFAAMLMAGL

SEQ ID NO: 18548 - protein, 165 aa, Secale cereale
MMASSATTVAPFQGLKSTAGLPVSRRSSGSLGNVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 18549 - protein, 338 aa, Arabidopsis thaliana
MADKKIRIGINGFGRIGRLVARVVLQRDDVELVAVNDPFITTEYMTYMFKYDSVHGQWKHHELKVKDDKTLLFGEKPVTVFGIRNPEDIPWGEAGADFVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPSLNGKLTGMSFRVPTVDVSVVDLTVRLEKAATYDEIKKAIKEESEGKMKGILGYTEDDVVSTDFVGDNRSSIFDAKAGIALSDKFVKLVSWYDNEWGYSSRVVDLIVHMSKA

SEQ ID NO: 18550 - protein, 174 aa, Brassica napus
SLKYMLLCKIMVSQADDVAGIISSKAGLQYVGPDLDAMKAVADAHSKRSLKLFENALRDYKAQLEDDPIVHRHLSSLYDTLLEQNLCRLIEPFSRVEIGHIAELIGLPVDHVEKKLSQMILDKKFAGTLDQGAGCLIIFEDPKADAIYSATLDTIANMGKVVDSLYVRSAKIMS

SEQ ID NO: 18551 - protein, 114 aa, Triticum aestivum
  misc_feature (7)..(7): Xaa can be any naturally occurring amino acid
  misc_feature (9)..(9): Xaa can be any naturally occurring amino acid
  misc_feature (14)..(14): Xaa can be any naturally occurring amino acid
  misc_feature (35)..(35): Xaa can be any naturally occurring amino acid
  misc_feature (48)..(48): Xaa can be any naturally occurring amino acid
  misc_feature (60)..(60): Xaa can be any naturally occurring amino acid
  unsure (1)..(114): unsure at all Xaa locations
GFPSPKXVXGHTKXLKGGFFPHLMGYITSGPVVCXAWEGDGVVASARXNLIGATNPLPSXEPGPIRGDLAVQTREGMSSHGSDSPGNGKRGIGLWFKEGELAQWGTVQTPWVIE

SEQ ID NO: 18552 - protein, 527 aa, Oryza sativa (japonica cultivar-group)
MQGANMLLDEPVRLTSVLTPVKPKVFPSLTKIVGTLGPNSHSVEVIQECLTAGMAVARFDFSWMDASYHQETLNNLRKAAQNVNKLCPVMLDTLGPEIQVHNSTGGPIELKAGNHVTITPDLSKAPSSEILPIKFGGLAKAVKKGDTLFIGQYLFTGSETTSSWLEVVETSGENVECLVTNTATLAGPMFTLHVSKAHVSLPTLSDYDKEVISTWGLHNSVDIISLSHTRSAEDVRELRSFLQSHGLQDTQIYAKVENTEGLDHFDEILQEADGVIISRGDLGIDLPPEDVFISQKTAIKKCNLAGKPVIITRVVDSMIDNLRPTRAEATDVANAVLDGTDGILLGAETHRGPYPVDAVSTVGRICAEAESVYNQLVHFKKLVKHVGDPMPHEESVASSAVRTAMKVKAAAIVVFTFSGRAARLVAKYKPPMPVLAVVFPREGSDPTKWRSYGTTQARQCFAARGVYPLMASTEEAETGGLTREEYGIKLAQNYGRSVGMLKPYDRLIIFQKIGDSSVVKIIECDSS

SEQ ID NO: 18553 - protein, 534 aa, Staphylococcus aureus subsp. aureus MRSA252
MKQFNVLVADPISKDGIKALLDHEQFNVDIQTGLSEEALIKIIPSYHALIVRSQTTVTENIINAADSLKVIARAGVGVDNINIDAATLKGILVINAPDGNTISATEHSLAMLLSMARNIPQAHQSLTNKEWNRNAFKGTELYHKTLGVIGAGRIGLGVAKRAQSFGMKILAFDPYLTDEKAKSLSITKATVDEIAQHSDFVTLHTPLTPKTKGLINADFFAKAKPSLQIINVARGGIIDEKALIKALDEGQISRAAIDVFEHEPATDSPLVAHDKIIVTPHLGASTVEAQEKVAISVSNEIIEILIDGTVTHAVNAPKMDLSNIDDTVKSFINLSQTVGELAIQLMYNAPSSIKITYGGDLASIDSSLLTRTIITHILKDDLGPEVNIINALMLLNQQQVTLNIENNKAETGFSNYLEVELSNDSDSVKVGASVFTGFGPRIVRINNFSVDLKPNQYQIVSYHNDTPGMVGKTGALLGKYNINIASMTLGRTEAGGDALMILSVDQPVSNNIIDELKQVGEYNQIFTTELTVQS

SEQ ID NO: 18554 - protein, 281 aa, Bacillus clausii
MTKKMNKYNGKKLSRGEPPNFSGQHFMHNKRLLKEIVDKADVSVRDTVLELGAGKGALTTILSERADRVLAVEYDQKCIEALQWKLVGSKNVSILHQDIMKVALPTEPFVVVSNIPYSITTAIMKMLLNNPKNKLQRGAIVMEKGAAKRFTSVSPKDAYVMAWHMWFDIHYERGISRSSFSPPPKVDSALVRIVRKQHPLFPYKEAKAMHDFLSYALNNPRAPLDQVLRGIFTAPQAKKVRQAIGVKPETPVAMLHARQWAMVCDAMVRHVPKVYWPRRKR

SEQ ID NO: 18555 - protein, 858 aa, Brassica napus
MKGVRKTYDSSYTLSFLLVFFVMFLFHPALSIHINTLSSTESLTISNNRTLVSPGNVFELGFFRTTSSSRWYLGIWYKNLPYKTYVWVANRDNPLSDSIGTLKISNMNLVLLDHSNKSVWSTNLTRGNERSPVVAELLENGNFVIRYSNNNNASGFLWQSFDFPTDTLLPEMKLGYDRKKGLNRFLTAWRNSDDPSSGEISYQLDTQRGMPEFYLLKNGVRGYRSGPWNGVRFNGIPEDQKLSYMVYNFTDNSEEAAYTFRMTDKSIYSRLIISNDEYLARLTFTPTSWEWNLFWTSPEEPECDVYKTCGSYAYCDVNTSPVCNCIQGFKPFNMQQWELRVWAGGCIRRTRLSCNGDGFTRMKNMKLPETTMAIVDRSIGRKECKKRCLSDCNCTAFANADIRNGGSGCVIWTGELEDIRNYFDDGQDLYVRLAAADLVKKRNANGKTIALIVGVCVLLLMIMFCLWKRKQKRAKTTATSIVNRQRNQDLLMNGMILSSKRQLPIENKTEELELPLIELEAVVKATENFSNCNKLGQGGFGIVYKGRLLDGQEIAVKRLSKTSVQGTGEFMNEVRLIARLQHINLVRILGCCIEADEKMLVYEYLENLSLDSYLFGNKRSSTLNWKDRFNITNGVARGLLYLHQDSRFRIIHRDMKVSNILLDKNMTPKISDFGMARIFARDETEANTRKVVGTYGYMSPEYAMDGVFSEKSDVFSFGVIVLEIVSGKRNRGFYNLNHENNLLSYVWSHWTEGRALEIVDPVIVDSLSSLPATFQPKEVLKCIQIGLLCVQERAEHRPTMSSVVWMLGSEATEIPQPTPPGYSLGRSPYENNPSSSRHCDDDESWTVNQYTCSDIDAR

SEQ ID NO: 18556 - protein, 421 aa, Silicibacter sp. TM1040
MRAARERAYAVCGAGICTARGLSRQGRQRRGQGLLDRAAPRAKGLLHMSYETPGPVESELRDAISPIEEIIDAARAGKMYILVDHEDRENEGDLIIPAEFADADAINFMATYGRGLICLPMTAERIDRLGLPMMAVNNSSRHETAFTVSIEAREGVDTGISAADRALTVATAINEQNTMAAIATPGHVFPLRAKRGGVLVRAGHTEASVDISRIAGCHPSAVICEIMKDDGTMARLPDLVEFAKTHDMKIGTISDLIAYRAKNDNLVDETARSTVTSEYGGDWEMRIFTDQTHDVEHVVLIKGDITTPEPVLTRTHALHEASDLLGLGPKPAGELPRAMELIADEGRGIVCLFRQPRNALYASDEEGVRTIKQTGLGAQILNKLGVEELILLTDSPQTKYVGLDAYGLSIVGTRPILSRDS

SEQ ID NO: 18557 - protein, 287 aa, Rhodopseudomonas palustris CGA009
MSAIDDLPPLREVIRRHDLAARKSLGQNFLLDLNLTARIARAAGPLEGVTVVEIGPGPGGLTRALLATGAKRVIAIERDERALGALEEIAAHYPGRLDIISGDAMEFDPRPLLNGDRARIVANLPYNIATPLLIGWLCAEPWPPWYEMMVLMFQREVAQRIVAHHDDDAYGRLAVLANWRAETQMLFDISPSAFVPPPKVTSSVVRLVPRAQPEPCDRAALEQVAAAAFGQRRKMLRQSLKSLGVDPAQLTAAAGIDPARRAETVPVSGFVAMANELANSRAIRTQA

SEQ ID NO: 18558 - protein, 165 aa, Hordeum vulgare subsp. vulgare
VMASSATTVAPFQGLKSTAGLPVSRRSSASLGSVSNGGRIRCMQVWPIEGIKKFETLSYLPPLTTEALLKQVDYLIRSKWVPCLEFSKVGFVFREHNSSPGYYDGRYWTMWKLPMFGCTDATQVLNEVEEVKKEYPDAYVRIIGFDNLRQVQCVSFIAFRPPGCE

SEQ ID NO: 18559 - protein, 289 aa, Salmonella enterica subsp. enterica serovar Paratyphi A str.
MEYSILSNNLKMPMVGFGVFKVTDKEECQQSVLSAIRSGYRLIDTAAVYGNEDAVGDAVREAIATGLCTREELFITSKLWVQDMANYDLAKAGIEASLKKSGLDYFDLYLLHQAMGDYFSAWRALEDAYKAGKLKAIGVSNFYAHVLANFCETVRITPMVNQVELHPYFAQPAALETMKHYNVQPEAWAPLGGGRHKPYENVMLQRIADAHQKTIAQVVLRWNVQRGVTVIPKSTRQERIEENFAIWDFSLTDNEMAQINALDLGYVGEAVKHFNPEFVRGCLGVKIHD

SEQ ID NO: 18560 - protein, 516 aa, Oceanospirillum sp. MED92
MTQKRATKALIILDGYGVESSESSAIQAANTPVWDKLLAENPNSRIQTSGMAVGLPDGQMGNSEVGHMNIGAGRVVYQNFTRISKAIEDGEFFDNAVLVDAMDKAISVGKAVHIVGLLSPGGVHSHEEHIFALLEMAVKRGAEKLYVHAILDGRDMPPRSAEPSLLRTEEKLAELGVGAIATVAGRYFSMDRDNRWDRVQQGYDAMTSGQAPCTATSAVGALQDAYGRDENDEFVQATVITDTEGNPKGVVSDGDALICANFRPDRAREITRAFTEKADFSGFERAATPELASYVMMTQYAADIQADCAYPPQAISNDLGEFLSGIGKTQLRIAETEKYAHVTFFFNGGQEEVYPGEDRILVPSPDVATYDLQPEMSAPEVTEKLVEAIRSGKYDLIVCNFANGDMVGHTGKFDAAVKACEVVDDCVEKVLAALREVDGEALITADHGNVELMVNPETGQPHTSHTNWPVALIYDGPRNGELNLADGALCDLAPTLLSLMGLEAPEEMSGKPLASF

SEQ ID NO: 18561 - protein, 287 aa, Listeria innocua
MTIQWFPGHMAKARREVTEKLKLVDVIFELVDARIPLSSSNPMLEEIIHQKRRVIILNKADTADEKTTKEWIDYFAEKGLPAVAVNAQEGKGLFKIEQAAEKLMAEKFERLRSKGMKPRAIRAMILGIPNVGKSTLINRLAKKNIARTGNKPGVTKAQQWIKVGKTLELLDTPGILWPKFEDQEIGYKLALTGAIKDDLLQMEEIAGYGLRFLEKHYPDRLQNWLKVEKVSEDPIETLAFIAEKRGLLDRYNDPDYSRAAETVVREIRQQKLGRMSFDFPNWEDDAE

SEQ ID NO: 18562 - protein, 165 aa, Avena sativa
VTASSATSVAPFQGLKSTAGLPVGRRSNAGLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCE

SEQ ID NO: 18563 - protein, 149 aa, Mycobacterium sp. MCS
MTVPETGAGTLSAVTERTLVLIKPDGVQRRLVGEILGRIERKGLTLAALELKTVDDELARRHYAEHEGKPFFGSLLEFITSGPVVAAIVEGPRAIAAFRQIAGGTDPVEKATPGTIRADLALVTQDNLVHGSDSPESAAREIDLWFPGR

SEQ ID NO: 18564 - protein, 354 aa, Agrobacterium tumefaciens str. C58
MAYGRMPKRCNGSAASSRIQFEVRMGSRNILVTGPAINEQAVKLITDNGYQVSYVPPYTSEADLVRIVTELDPVGVVVRMGRFSEAAIKAAPSLRVLSKHGVGVDNIDVDAASRREIPVVVAAGANALSVAEHAITLLFAVVKRIVPLDSGIRAGRWEKAGYSGKELAGMIIGLVGFGAIARQTAVFARGFGLKVQAYDPFTDETAFVEAGVHRVADVDDLISSSDILSLHCPLTPDTRNLLDDRRLGMMKPGSFIINTARGGLIDEDALLRAVESGHIAGAGLDTFQIEPPAANHPFWQNQKIVVTPHIGGVTQEANVRVGVDAVEGIFAIVEGRHLGRERIVNHRALAKTPA

SEQ ID NO: 18565 - protein, 165 aa, Aegilops speltoides
VMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 18566 - protein, 467 aa, Exiguobacterium sibiricum 255-15
MQLKREMTSRHLFMISLGGIIGTGLFLGSGLTISQAGPLGAVLSYIVGGTIMYLTMLCLGEMAVHMPVSGSFQTYTTRFIGPGIGFAVGWIYWLGWAVTVALEITAAGSLMDRWFPNTPIVIWCAIFTVILFGLNAVSAKAFGEAEFWFSSLKVLAILFFIALGGAAWFGWIDMTAARPESLFANFTSNGLFPNGALGVLTTMIAVNFAFQGTELIGVAAGESNDPEKSIPKAIRNTVWRTFIFFVLSITIVGALIPYETAGGISSPFIMVFDAIGIPYAADLMNIVVLTALLSVGNSGLYAATRMLWSMSQEGMISKKLAIVNSRGVPMRALCFTMLFAMLSLLTAFFAEDTVFIWLLSLAGLGAQVGWISISASQIAFRRQFIKNGHTVSELKFKTPFFPVLPIISFSLNMLVLISLAFQADQRIALYIGVPFFLLTWGCYHLFVKGKHIAAQTERQAASSTLES

SEQ ID NO: 18567 - protein, 581 aa, Rhodopseudomonas palustris CGA009
MSAFELVTELSARFKDAVLGEQMTADRFPTVWIRPDATIDVHRFLRQEIDRPFKMLVDLWAIDETARKHRDGLPPSGITIASHLMSHERNADIRIKIALDAEYPRAKSIGSVFPNAPWYEREAYDMFGVEFEAQPHSLRILLPPGWEGHPMRKTQPGRATERPLFNMTASLFDAKEHALAADPEKFGLPTHRDGVELMILNYGPHSMATHGVFRIVLALDGEEIVAARPDIGFHHRGAEKMAERQTWHNFLPYTDRVDYLGGVMGEMPYLQAVEKACGIKVPDRALTVRIMLSEMFRIMNHLLFYGTMAQDTGAMSPVFYMFTDRERGYRVIESITGARMHPGFFRIGGLSMDLPDGWDRLVREFLDWMPSRLDDYEGMVLRNEIFRARTKGIAAYDTAMALDWGVTGPGLRATGYAWDVRKARPYAGFENFDFEIPVGHAGDCYDRTVVRVEEIRQSLKIIRQCVDNMPSGPIKADHPLTTPPPRERMLHDIETMIHHFVSTSWGPVLPPGEYTGQVETVRGLTQFALISDGEPSSYRTRIRTPSFAHLQMISAVAPGMMVADLVAYLGSIDYVMSDVDR

SEQ ID NO: 18568 - protein, 154 aa, Aegilops speltoides
VMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCV

SEQ ID NO: 18569 - protein, 168 aa, Triticum aestivum
MAARARTVAAMSSNSSILLAAAVALALLVSSASAQSGCTAALVGLYPCMNYISGNDTAPTKSCCSQLGSVVQSQPQCLCSALGGDSSSLGGVTINKTRALELPNACNVQTPPASKCDGAGGGSAPGAGSGSKTTPTAYLQGSGGSSLHGTARLVLALSAAAIFVVSTV

SEQ ID NO: 18570 - protein, 355 aa, Frankia sp. CcI3
MPATMQALAFLGIGKAGVIEKPIPKPGPTDAIVRTTSALICTSDVHTVRGAIPVPEGRALGHEAVGVVHDLGAAVTGFEAGERVAVGALTPCFHCGPCQRGFSTQCQGMLGGYKFTTQRDGNMAEYFLVNNAAANLARIPADLPDEKAVYATDMLSTGFGGAENAQLRLGESVAIFAQGPVGLSATIGCRLLGAGLIIAVEGRPERQELARRFGADVVVDPAAGDVVNQILDLTGGVGVDGAIEALGHPQTFEDCIRVTKPGGRISNIGYHGENPAPLQIPLEPFGLGMSDKKILTSLCPGGSDRLERIFTLMRSGRVDPTPMTTHEFGFDEIERAFSMMETKEDGVIKPLIRFA

SEQ ID NO: 18571 - protein, 322 aa, Candida tenuis
MSASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIAFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPKSNLPERLVQNRSFNTFDLTKEDFEEIAKLDIGLRFNDPWDWDNIPIFV

SEQ ID NO: 18572 - protein, 181 aa, Zea mays
MASSMLSSATVVSSPAQAAMVAPFTGLKSSAAFPVTRKTDTDITSMASNGGRVNCMKVWPPVGKKKFETLSYLPDLTDVELSKEVDYLLRNKWIPCVEFELEHGFVYREHGNTPGYYDGRYWTMWKLPLFGCTDSAQVLKEVQECKKEYPNAFIRIIGFDNNRQVQCISFIAYKPPSFTGA

SEQ ID NO: 18573 - protein, 338 aa, Hypocrea lixii
MSIKVGINGFGRIGRILLSNALEKPELSVVAVNDPFIEPTYAAYMLKYDSSHGLFKGDIEVDGQNLVVNGKPIRFYSERDPANIKWSETGAEYIVESTGVFTTIDKAKAHLNGGAKKVIISAPSADAPMFVMGVNHKDYDGTPTVLSNASCTTNGLAPLVKIVNDNFGIVEGLMTTVHSYTATQKTVDGPSGKDWRGGRGAAQNIIPSSTGAAKAVGKVIPAMNGKITGMSFRVPSANVSVIDLTVRLEKAASYEEITSAIKKAADGELKGIMAYTSDEVVSTDMLGNNNSSIFDIKAGISLNPNFVKLVSWYDNEWGYSRRVLDLLEHVAKVDASKK

SEQ ID NO: 18574 - protein, 270 aa, Anabaena variabilis ATCC 29413
MTIKFGLIGGGVMGEALLSRLIARGIYQPSEVIVSEPQTARQAFLQQKYHVGVTTDNSLVFTQAQDVVFLAVKPQVFSAIAQELADTVFTDHSPLVVSILAGVSLSQLEAAFPQSPVIRAMPNTPATVGAGMTAICSGAYTYAQHQKLAQQIFSAVGEVVEVSESLMDAVTGLSGSGPAYVALLVEALADGGVASGLPRGIANQLALQTVLGTAQLLHESKLHPAELKDRVTSPGGTTIAGIAQLEKAGFRSALIEAVKAATWRSQELGK

SEQ ID NO: 18575 - protein, 518 aa, Oryza sativa
  misc_feature (226)..(226): Xaa can be any naturally occurring amino acid
  unsure (1)..(518): unsure at all Xaa locations
MGEGINGDAGDLAAAPYDQWLPFSPAGGSPRPSARYKHAAEVVREKLYVVGGSRNGRYLSDIQVFDFRTLKWSALSAARDSSQLNIENNTTDPSFPALAGHSLVNWKKYIVVVAGNTRTSTSNKVSVWLINVETNSWSSVDTYGKVPISRGGQSVSLVGSRLIMFGGEDNKRRLLNDLHILDLETMMWEEVKTGKGGPAPRYDHSAAVYADQYLLIFGGSSHSTCXDIYLLDLQTMEWSQPDTQGAHINPRSGHAGTMIDENWYIVGGGDNASGSTDTIMMNASKFVWSVVTSVPARDPLACEGLTLCSTTVDGEKFLVAFGGYNGQYNNEIFVMKLKPRNLVQPRLLQSPAAAAAAASVTAAYAVITDEKTRDIVATDDLDVKRVQPSGSSKQITTELDALNGEKGKLESRLAEVRDENSKLKDRLDMVKLSHGELTKELKSVQHQLAAEGSRCQKLESQIAAAHKRLESTDSLENELEVLRQQISQVEQTMTTAQRQKSGGVWKWVAGSAEISDDE

SEQ ID NO: 18576 - protein, 256 aa, Brucella suis 1330
MTKFWIGTSWKMNKTLAEARLFAEALKAADAGRSPDIQRFVIPPFTAVREVKEILSGTSVKVGAQNMHWADQGAWTGEISPLMLKDCNLDIVELGHSERREHFGETNETVGLKVEAAVRHGLIPLICIGETLEDRESGRAAAVLEEEVRGALSKLSEAQKQAEILFAYEPVWAIGENGIPASADYADARQAEIIAVAQSVLARRVPCLYGGSVNPGNCEELIACPHIDGLFIGRSAWNVEGYLDILARCATKVQAN

SEQ ID NO: 18577 - protein, 1151 aa, Saccharomyces cerevisiae
MDQDNNNHNDSNRLHPPDIHPNLGPQLWLNSSGDFDDNNNNNNNNNNNNSTRPQMPSRTRETATSERNASEVRDATLNNIFRFDSIQRETLLPTNNGQPLNQNFSLTFQPQQQTNALNGIDINTVNTNLMNGVNVQIDQLNRLLPNLPEEERKQIHEFKLIVGKKIQEFLVVIEKRRKKILNEIELDNLKLKELRIDNSPQAISYLHKLQRMRLRALETENMEIRNLRLKILTIIEEYKKSLYAYCHSKLRGQQVENPTDNFIIWINSIDTTESSDLKEGLQDLSRYSRQFINNVLSNPSNQNICTSVTRRSPVFALNMLPSEILHLILDKLNQKYDIVKFLTVSKLWAEIIVKILYYRPHINKKSQLDLFLRTMKLTSEETVFNYRLMIKRLNFSFVGDYMHDTELNYFVGCKNLERLTLVFCKHITSVPISAVLRGCKFLQSVDITGIRDVSDDVFDTLATYCPRVQGFYVPQARNVTFDSLRNFIVHSPMLKRIKITANNNMNDELVELLANKCPLLVEVDITLSPNVTDSSLLKLLTRLVQLREFRITHNTNITDNLFQELSKVVDDMPSLRLIDLSGCENITDKTIESIVNLAPKLRNVFLGKCSRITDASLFQLSKLGKNLQTVHFGHCFNITDNGVRALFHSCTRIQYVDFACCTNLTNRTLYELADLPKLKRIGLVKCTQMTDEGLLNMVSLRGRNDTLERVHLSYCSNLTIYPIYELLMSCPRLSHLSLTAVPSFLRPDITMYCRPAPSDFSENQRQIFCVFSGKGVHKLRHYLVNLTSPAFGPHVDVNDVLTKYIRSKNLIFNGETLEDALRRIITDLNQDSAAIIAATGLNQINGLNNDFLFQNINFERIDEVFSWYLNTFDGIRMSSEEVNSLLLQVNKTFCEDPFSDVDDDQDYVVAPGVNREINSEMCHIVRKFHELNDHIDDFEVNVASLVRVQFQFTGFLLHEMTQTYMQMIELNRQICLVQKTVQESGNIDYQKGLLIWRLLFIDKFIMVVQKYKLSTVVLRLYLKDNITLLTRQRELLIAHQRSAWNNNNDNDANRNANNIVNIVSDAGANDTSNNETNNGNDDNETENPNFWRQFGNRMQISPDQMRNLQMGLRNQNMVRNNNNNTIDESMPDTAIDSQMDEASGTPDEDML

SEQ ID NO: 18578 - protein, 248 aa, Clostridium perfringens SM101
MEKKVLATVGNTEITSDYIDEIIARYPAQQQAMLASDEGKRQVLEQAIAFELMSEFAKETGLDKTEEFKDQLNKFAKELLAQMVMKKTLSSVTVTDDEAKDFYEEHKENFVELETVTAKHILVASEEDAKKVEEEIASGSITFEDAANKYSSCPSKEQGGNLGSFSKGMMVPEFEEAAFNLELGVVSAPVKTQFGYHLIKVEDKTEAKTKAFEDVKEQVVNMLIQERQQKKYLELIKELREKYGVKLA

SEQ ID NO: 18579 - protein, 534 aa, Vibrio fischeri ES114
MELLFIIAAFVMGFIALKINLPPLVGFLLAGFGLHALGFQSNDALETFADLGVTLLLFSIGLKLDIKTLLAKEIWLGATLHNVFSTLFFTFALLGLKLLGINMLANIETAQLVLFGFALSFSSTVFAVKALQEKGEMNATYGTLAIGILVMQDIFAVVFLTASTGKIPEITALALFALPLFRPLFFKLLDWAGHGEMLVLYGIFLALVAGAGTFELVGMKPDLGALILGMLLAGHAKASELSKSLFNLKEVLLICFFLNIGLSAAPTISGLGLALILILLLPVKGFLYFIIINKFKFRVRTSLLASLTLFNYSEFGLIVGGLAFKMGWLPADTLVAIAIAVSISFIISAPLNNFGHTIYQRSRHWLKEHTAERLNPMDKLINPGRAQILILGMGRIGSGAYDELKEKYGDIILGIELREESAKQHQELGRNVISGDATDPDFWERILSTSHVKLVLLAMPNHQGNQFALEQLQTRNYQGQTAAIAAYNDQIDGLIEQGVDAAFNIYHEAGSGFARHVSEQLDPQFNHHKDYITH

SEQ ID NO: 18580 - protein, 160 aa, Triticum aestivum
  misc_feature (61)..(61): Xaa can be any naturally occurring amino acid
  unsure (1)..(160): unsure at all Xaa locations
MDASATGAGAKAKKGAAGRKAGGPRKKSVTRSVKAGLQFPVGRIGRYLKNGRYAKRVGTGXAPVYLAAVLEYLAAELLELAGNAAKDNKKSRIVPRHLLLAVRNDQELGRLLAGVTIAHGGVLPNINPVLLPKRTAEKEPKEGKSPKKVAKSPKKADKKA

SEQ ID NO: 18581 - protein, 589 aa, Nostoc punctiforme PCC 73102
MQLRDSLRRTKIVATIGPATSSPEMLKAIIEAGATTLRLNFSHGTHADHQRSIRLIRQTAFELNQPVAILQDLQGPKIRLGKFDNGSIVLAKGDRFTLTNRPVVGTQEISCVTYDYLAEEVPVGAKILLDDGRVEMVVEEINRDKGDLHCRITVPGKLSNNKGVNFPGVYLSIKAMTDKDREDLMFGLDQGVDWVALSFVRNPQDMIEIKELISSTGKQVPVVAKIEKHEAIEQMEAVLALCDGVMVARGDLGVELPAEDVPVLQKRLIATANRLGIPIITATQMLDSMVSNPRPTRAEVSDVANAILDGTDAVMLSNETAVGSFPVEAVATMARIAERMEQEEAQHLNLRSVRDSRRSIPNAISQAVGQIAEQLGAAAIMTLTQTGATARNVSKFRPNTPILAVTPHVNVARQLQMVWGVKPLLVLGLPSTGQTFQAAINVAQELKLLSEGDLVVMTAGTLQGISGSTDLIKVEVVTAVLGHGIGLGQGLVSGRARVANTGMDVSNFNPGDILVAPRTSADFVEAIRKSAGIITEEESLTSHAAVIGLRLGVPVIVGVKQATQVIRDGAIITLDLQRGLIYSGAVRTP

SEQ ID NO: 18582 - protein, 82 aa, Oryza sativa
ESPLSELGVREWPKWGCEKNKFPWRYSPKKTFSLFQGKVKVFPHGPGKNFLEIPAGDLVVFPKGINCPWEVPEAVAKPSKFE

SEQ ID NO: 18583 - protein, 335 aa, Solibacter usitatus Ellin6076
MAIKVGINGFGRIGRNVVRAGLHNSDVEFVAVNDLTDTATLAHLLKYDSVLGTLPETVTHDATSITVGGKTIKVFATKDPAELDWASVGAQIVIESTGRFTDGKDAAKHMRGTVKKVIISAPAKNEDVTLVLGVNDAAYDAKKHNIISNASCTTNCLAPVVKVLNEKFGVEKGSMTTIHSYTNDQNVLDFPHKDLRRARAAALNMIPTTTGAAKAIGLVLPELKGKLDGYSMRVPTPDVSVVDFVCILKKPSTTEAVNAALKAASEGELKGILGYTEDPVVSTDMLRNPNSSIVDAQLTKVLDGNLLKVVAWYDNEWGYSSRVVDLVGFLAAKGL

SEQ ID NO: 18584 - protein, 339 aa, Ralstonia eutropha JMP134
MTRISLTRYLVEEQRKHNTIQPELRLLIEVVARACKAISNSVNKGALAGVLGSAGTGNVQGETQQKLDVIANEVLLDANEWGGHLAAMASEEMESFYEIPNRYPKGEYLLMFDPLDGSSNIDVNVSIGTIFSVLHMPKPGQTVTEADFLQPGTHQVAAGYAVYGPQTTLVLTVGNGVHVFTLDREAGSFVLTQSDVQIPEDTKEFAINMSNMRHWAPPVRKYIDECLAGDEGPRGKNFNMRWIASMVADVHRILTRGGIFMYPWDKREPEKAGKLRLMYEANPMAMLIEQAGGAATNGHIRILDVQPEKLHQRVSVILGSKNEVERVTRYHHEAAGQQG

SEQ ID NO: 18585 - protein, 363 aa, Exiguobacterium sibiricum 255-15
MMTKLVTAVEDTTKVKTMRALVKEERGFGAVLKEVAVPSPKRGEVLIRVEATSICGTDVHIYEWDAWAASRVNPPYVFGHEFSGEVVELGEGTKRLKLGDRVSAETHIVCHQCKQCLRGQYHICKNTKIIGVDTQGCFAEYVVMPEENLWVNPEDMPAAIASIQEPMGNAVHTVLASDVSAKTVAIVGCGPIGLMAVSVAKAAGAAEVIAIDVNPYRLELAKTMGADVVIDSRHEDVLERVRMMTDGDGIDVVCEMSGHPVAIRQAFEMVTAGGDVNILSLPVKPVEIDLTNHVVFKGVRVQGITGRKMYETWSQVSAFLSSGKVDVKPLITHTLPLERFEEGFELMRQGKCGKVVLQPRGTN

SEQ ID NO: 18586 - protein, 462 aa, Oryza sativa
MDPCPFVRVLVGNLSLKMPVAPRPAGAGAGVHPSTSPCYCKIRLNKLPYQTADAPLLLPPSPEASAAPAPAPATGALAAAFHLSKADLDRLTAKPSLFGSRTARLKIVVYAGRRGTTCGVGGGSGRLLGKVVIPLDLKGASAKPVVYHSSWICIGKRGRKPSSVSAANAQLNITVRAEPDPRFVFEFDGEPECSPQVLQVQGSMKQPMFTCKFSCRSNSDLRSRSMPADMGSGGRNWLTAFGSDRERAGKERKGWSVTVHDLSGSPVALASMVTPFVASPGTDRVSKSNPGAWLVLRPGDGTWKPWGRLECWRERGAGAAAGDSLGYRFELVLPDPTGMGVGVSVAESTIPASKGGRFAIDLTATQQFGRSGSPACSPCGSGDYGMWPFGSCRGFVMSAAVQGEGKCSRPAVEVGVQNVGCAEDAAAFVALAAAVDLSMDACRLFSHRLRRELSASRSDLLR

SEQ ID NO: 18587 - protein, 120 aa, Glycine max
MGSCEATNVVLSKIKNFDPENASKIMGYLLMNLEESELIRVACSPDTVLQTLVLRVKSHLGLTLSTPSSPSQFPPSPLNPIARLTGTSSNPFSRGGPTNGFDFTRNPASPSSHSHAWNFP

SEQ ID NO: 18588 - protein, 325 aa, Shewanella oneidensis MR-1
MQTLAQHLTSKAVNESLAQLILTLADTSKAISHAVRHGALAGVLGATEQENVQGETQKKLDIITNDMLKDALKADGTVRGLASEEEDHVVEVSANGQYLVCFDPLDGSSNIDINSLVGTIFSVLPAPQGELTEASFLQSGRNQLAAGYVLYGPSTMLALTTGQGVQLFTLHPETNEFLLTNATMSISPDTSEFAINMSNQRFWEAPMQTYIADLLLGKIGPREKSFNMRWIAAMVGDVHRVLSRGGIFTYPTDNKDPKKPYKLRLMYEANPMAFLVEQAGGKASTGYETILDIQPTQIHQRVAVILGSANEVDACLSYHGIDSRK

SEQ ID NO: 18589 - protein, 340 aa, Brucella suis 1330
MTLVGNFSPLVLVGDSDRVEAETVGAYLDGWAGHDKVRLATANAIKAILSGAGRLVGRIARGYLPGDPGKLVGVNSDQDQQKSIDVGSHNLFVELLIAAGVASILSEEADLPVAGKADGLVAVAIDPLDGSGNVGLGAPLGTIFSIFPADVEEPFLQPGNRQIAAGYVSYGNSVDLGFSVGEGVIFATLDPVSGQFHITRRNVKLPERTSDLAFNASVQRHLSAGMQAYVNDAFLGKDGPRGRNFNMRWLGAAVGDMHRIMQRGGLFFYVNDSRPGYEKGRLRLVYEANPIAFLAREAGGKATDGSRPILDIVPQTYHERSALVFGVAEELDILGEYFVK

SEQ ID NO: 18590 - protein, 728 aa, Mycobacterium tuberculosis CDC1551
MTHPDPARQLTLTARLNTSAVDSRRGVVRLHPNAIAALGIREWDAVSLTGSRTTAAVAGLAAADTAVGTVLLDDVTLSNAGLREGTEVIVSPVTVYGARSVTLSGSTLATQSVPPVTLRQALLGKVMTVGDAVSLLPRDLGPGTSTSAASRALAAAVGISWTSELLTVTGVDPDGPVSVQPNSLVTWGAGVPAAMGTSTAGQVSISSPEIQIEELKGAQPQAAKLTEWLKLALDEPHLLQTLGAGTNLGVLVSGPAGVGKATLVRAVCDGRRLVTLDGPEIGALAAGDRVKAVASAVQAVRHEGGVLLITDADALLPAAAEPVASLILSELRTAVATAGVVLIATSARPDQLDARLRSPELCDRELGLPLPDAATRKSLLEALLNPVPTGDLNLDEIASRTPGFVVADLAALVREAALRAASRASADGRPPMLHQDDLLGALTVIRPLSRSASDEVTVGDVTLDDVGDMAAAKQALTEAVLWPLQHPDTFARLGVEPPRGVLLYGPPGCGKTFVVRALASTGQLSVHAVKGSELMDKWVGSSEKAVRELFRRARDSAPSLVFLDELDALAPRRGQSFDSGVSDRVVAALLTELDGIDPLRDVVMLGATNRPDLIDPALLRPGRLERLVFVEPPDAAARREILRTAGKSIPLSSDVDLDEVAAGLDGYSAADCVALLREAALTAMRRSIDAANVTAADLATARETVRASLDPLQVASLRKFGTKGDLRS

SEQ ID NO: 18591 - protein, 527 aa, Oceanospirillum sp. MED92
MDFIWILFAFVCGYLMRLVEMPPLIGYLFAGFFLHFIGIEPVSSLDTLADLGITLMLFTIGLKLNVKDLLKTEVWASTLSHMGIWILITGSLFLLLATLAVPYFTDLDLKSAALIAFALSFSSTVCIVKLLEESGEMKTRHGQLAIGVLVMQDIVAVLFLVAATGKIPSIWAIGLLGIFLIKPLLNHMLMRAGHGELLPLAGFFLALGGYELFNLVGVKGDLGALVFGMLLSTHPKASELTKSLLSFKDLFLIGFFLSIGFTALPDWSMLGMATILAILIPLKYLMFFGIFTRLHLRGRTSYLSALALSNFSEFGLIVAYLCVDSGWLSEQWLVILALSVSISFILTSIIYRSAHSFYLRHKEKIKSYESLKPLASDIFIQPKDSEILVIGLGRVGKGAFKALHSMVGDKVWGMDADRNRIKKFQSKGLHVFYGDGEDADLWSNMDTHNIKLILLALPAIDDMLNIAEQLHSANYQGEIAAIARFPDEHDLLVEGGIDKVFNFYTEAGFGFAEESLQLIDYKKEASS

SEQ ID NO: 18592 - protein, 338 aa, Mycobacterium tuberculosis CDC1551
MQEAPHRVMPLVRPCPRPSDPGEYVRPMTANDNKTRKWSAADVPDQSGRVVVVTGANTGIGYHTAAVFADRGAHVVLAVRNLEKGNAARARIMAARPGAHVTLQQLDLCSLDSVRAAADALRTAYPRIDVLINNAGVMWTPKQVTKDGFELQFGTNHLGHFALTGLVLDHMLPVPGSRVVTVSSQGHRIHAAIHFDDLQWERRYNRVAAYGQAKLANLLFTYELQRRLGEAGKSTIAVAAHPGGSNTELTRNLPRLIRPVATVLGPLLFQSPEMGALPTLRAATDPTTQGGQYYGPDGFGEQRGHPKVVQSSAQSHDKDLQRRLWTVSEELTGVSFGV

SEQ ID NO: 18593 - protein, 255 aa, Magnetococcus sp. MC-1
MRRALIAGNWKLNGTTQAATALATAVRDGVAANKPDCDVLVCPTFTVLSAVQGVVAGSGVDLGAQNMAVASSGAFTGEISGEMLKDVGCSYVILGHSERRTLFGETNEQVAQKVASAYRDGLTPILCVGETLEQREAEQTMQVLEQQLLACLPVLPADAAKQQQLVVAYEPVWAIGTGKVASTAQAQEAHAFIRGLLAKELGANVADAVRILYGGSMKPDNAKELLGQADVDGGLIGGAALKANDFLAIMDGLTA

SEQ ID NO: 18594 - protein, 964 aa, Leptospira interrogans serovar Copenhageni str. Fiocruz L1-130
MNSTLQNQTKTNLEKVGTDPLDTFPRRHIGPNLQQTAEMLKELGLSSVEELIDKAVPVGIRLKKSLDLPKASTEHKILQNLKGIASQNQVFRSYIGAGYHSCIIPGVIQRNILENPGWYTAYTPYQAEISQGRLEALLNFQTMIIDLTGLEISNASLLDEGTAAAEAMFLAYSVRKNETAKKFFVSELCHPQTIDVVVTRANPLGIEVQIGNHESIELNEDFFGVLLQYPATDGKIIDYTSFIQRSHNVGAISTVAADLLALTLLKSPGEMGADIAVGSSQRFGLPLGFGGPHAGYFATKDEFKRSMPGRLIGVSKDSQGNSGLRLSLQTREQHIRRDKATSNICTAQVLLAVISSMYAVYHGPEGLKNIATRIYKFTSIFANVLKNAGFSITNEFFFDTITIQAGTKVQEILNRAYSKKINFREYKDGKIGITLDETVNLEDLKDLLEIFEIKNTDIEKLFVDVSNVPDSFKRKTSYLTHPVFQSHHTETKMLRYIRKLESRDLSLTTSMIPLGSCTMKLNATTEMYPVTWPEFGAIHPFAPADQTKGYKIIFEQLEKWLCEITGFAGVSLQPNAGSQGEYAGLLAIRRYHESRNESYRNVCLIPISAHGTNPASAAMAGFQVVVVSCDPNGNVDLEDLKAKAEEHKKDLAALMITYPSTHGVFEESVKEICQIVHSCGGQVYMDGANMNAQVGLTSPGEIGADVCHLNLHKTFCIPHGGGGPGVGPIGVAKHLVPFLPGHVLVDNATGNEHGAVSAAPWGSASIVLISWVYIALMGSEGLTNATRNSILNANYIAKRLEKVYPVLYKGKNGFVAHECILDLRPFKKSAGIEVEDVAKRLIDYGFHAPTMSFPVPGTLMIEPTESESLEELDRFCEAMLLIYQEILDVQSGTLDKTDNPLKNSPHTAAMVTSDRWDHLYPRERAAYPASWLKDHKFWPYVGRVDNVYGDRNLVCSCLPIESYQ

SEQ ID NO: 18595 - protein, 158 aa, Glycine max
  misc_feature (98)..(98): Xaa can be any naturally occurring amino acid
  misc_feature (100)..(100): Xaa can be any naturally occurring amino acid
  misc_feature (115)..(115): Xaa can be any naturally occurring amino acid
  misc_feature (130)..(130): Xaa can be any naturally occurring amino acid
  unsure (1)..(158): unsure at all Xaa locations
MDSSLISFPAVTTVNRAGAGMVAPFTGLKYMAGFPTIKTNNDITSIASNGGRVQCMHVWPPLGKKKLETLYYLADLDDAQLLEEVEYLLRKGWIPCLXIXLEHGFLYREHNRLPXYYDGRYCTMCKLPMXCCTDASQVSEELQEATTAYSSCFMRIIA

SEQ ID NO: 18596 - protein, 644 aa, Zea mays
  misc_feature (570)..(570): Xaa can be any naturally occurring amino acid
  unsure (1)..(644): unsure at all Xaa locations
MKLGSKPEIFVLQDLTWRCTTELESDVVVEVGEMSFYLHKFPLLSRSGVLQRMISEYQAPADGGGMCTLQLDDIPGGAKAFELAAKFCYDVKIELNALNVVCLRCAAEYLRMTDDYAEGNLITQAECFLVDVLANWKDSIKALETCEGVLPTAEDLHLVSRCITALASKACGSDAAAPVVRNASVDKDALWNGIRSGDTTSSAAAAAAAAGMDWWYEDVSFLSLPMFKRLIQAMEAKGMRDESIAGAIMFYAGRFLPGLKRNTSFSNALASYGADGSGGAGGGMSSRNITPRAASVSAPSEGDQRYFLEEIVALLPTKKGVASTKFLLGMLRTAMLLHASPLCRENLERRIGAQLEDASLDDLLVPNLGYHVETLYDIDCVQRILDYFMSSTDGIGTGYTSPALAEEGGGSLGIPQGATPSSSLSPITMVAKLMDGFLAEVAPDTNLKLPKFQALAAVVPDYARPVDDGIYRAIDIYLKSHPWLSESEREQLCRLLNCQKLSLEACTHAAQNERLPLRVVVQVLFFEQLRLRTSIAGWFFVSDNAAGGDGARPHAGGAIVPKGTAAIAGXPQADADSDVEGDAPDGKETITDVKARVSDLEKECKSMKQEIRRLGKPRRSWSLLTRKCGFGAKVQQAQTAMSGK

SEQ ID NO: 18597 - protein, 472 aa, Bradyrhizobium japonicum USDA 110
MTMDKRIIPLIMCGGAGTRLWPASREVRPKQFLPLFGSRSTFQDTLLRVSDASLFDRPIVITNASYRFMVLEQLAEIGIEADVILEPMRRDSGPAIAAGAVFAQNRASEAIVLALAADHVVQDKAAFVAACREGLTAASAGRIVTFGVKPERPATEYGYISLGEVISGEVHAVARFVEKPDAVKAADYVNSGYLWNSGNFMFPATVLLDEYRKVDAASVEAVSNAVTNAGRDLGFVTLEPEAFGSAKAISIDYAVMEKTSRAAVVPVSCGWSDVGSWHAVWELSEKDAQGNAAHGAAVFEDSRNCNVTTDSALVALEGVDDLVVVATADAVLVSRQKDANGLKRLVTKLKAVAPKVTEEHLKVHRPWGSYQSVDNGERHQVKRIVVKPGGRLSLQKHHHRAEHWIVVRGAARVTVNETVKTVHENESIYIPMGAVHRMENPGKIMLELIEVQTGSYLGEDDIIRIEDDYQRS

SEQ ID NO: 18598 - protein, 422 aa, Clostridium acetobutylicum
MTNKEIFEESKEYMPGGVNSPVRAYMDLNIDPPIIKSGKDSHLFDEEGKEYIDFIEAWGPMILGHKNQKVLNEVKEVLDEGVGFGAPTSLELKLAKYICTTVDNVEMIRMVNSGTEATMSAVKLARGYTKRDKIIKFAGCYHGHFDGFLVEAGSGVLTQNIPGSPGVPKGSIENTLIAEYNNVESVEVLFNKYKDEIAAVIIEPVAGNMGVIPAKKEFLVKLRELCTENQSILIFDEVMSGFRVAYKGAQSLYGVTPDLITFAKIMGGGFPCGAYGGKKEIMKQLSPLGPVYQAGTMSGNPVVMAAGYASLRQLHENPEYYTYMDKLGSKLEAGILEISKEKGIPLVVNRCVNMMTIFFNKAKEVKSYSDAKASDTKMFARFAEHMITSGIYVPPSQFEAMFLGVKHTEEDIERFLDVMKKL

SEQ ID NO: 18599 - protein, 180 aa, Triticum aestivum
MKALAGDSNASAPLLQATKISIPASSTGGAAEAALLGKGRYKVWALAAIALLALWSMSAASVSLRWSAGDLAAVISGDLDAPLRDDLDSLEMEEREKLVGRMWDMYTRTSDEVRLPRFWQEAFEAAYEELAGDDMQVRDTAISEIARMSAHRLELEQPMNANQEEGKVSIMNNDHGRVKQ

SEQ ID NO: 18600 - protein, 281 aa, Borrelia garinii PBi
MILSLLSMNINYNSITSIKQILKERKIAPRKLWGQNYLINESIRQKIIESLDIKENEKIWEIGPGLGAMTDILLKKTNLLTAFEIDLKYSEILNEKFGKLKNFKLIKGDFLKKYPNENKNIDKIFSNLPYNIASKVISKLIEENFLKEMVLTVQKELADRITAKTNSKNYSSFTVLVQSHFTAIKIIDIGENNFYPAPKVKSTTLKLIPKKNNIKDFKEFNKLIRTVFSGRRKKLKNTIINFIKNKAILEENFLKEYLGKRPENISVEEFIQISNNLNAYH

SEQ ID NO: 18601 - protein, 510 aa, Glycine max
  misc_feature (193)..(193): Xaa can be any naturally occurring amino acid
  unsure (1)..(510): unsure at all Xaa locations
MGDFNLALVIVAVVVCVIVFLVNVYLLVNYQHPDDANQAYFPKFVVVLGLSVAAISILMLPADVANRQACRHAIYNGACSLTLPMKDLWLAVYILDAVLVFFVIPFAMFFYEGDQDKSVGKRIKSALMWMVTTAIVCALVLGILYGLVGKVDFTIRHLSSSTTSFPSTWTFSSGQPCIGSDAHQCSAFSASPXTSEKTWTMRTTFPEYVAALATIVGSVLFAIFGIIGIACLPLGLIFSFIRRPKAVITRSQYIKEATELGKKTRELKKAAEALHQEERSGSKGRKFRKNVKEVEKELFQLEEDVKLLEEMYPQGEKAETTWALTVLGYLAKFVLGILGLIVSLAWVTHIIIYLLIDPPLSPFLNEVFIKLDDVWGLLGTAAFAFFCFYLLLAVIAGAMMLGLRLVFITIHPMKWGATLMNSFLFNVGLILLCSISVIQFCSTAFAYYAQATAAQEIFGHTLESLRGIKYLYKYNVFQIAFVVLAGLTFVYYAAFGWRRKKPSGRFQLST

SEQ ID NO: 18602 - protein, 669 aa, Oryza sativa (japonica cultivar-group)
MEGTSSGEEVEDGTGPSPEAEEDDDPAPYVGQRFPTHDAAHELYSGFARRRGFSIRRHRTEGKDGVGRGLTRRYFVCHRAGNPPAKPFAAGAGDRPQRNRRSSRCGCKAYMRIGRSAIAAAAAGEAEGEWRVTGFSNHHNHELLGQDQVRLLPAYRVVSGDDRDRILMLARSGISVQQMMRIMELERRVEPGNLPFTEKDVRNLIQSCRKSDQEESVDLIKMCRRFQEKDPDFKYEFTKGASNRVENVAWSFASSVQSYEMFGDAVVFNTTHRLPALDMLLGIWVGLNNHGMPCFFGCAFLREESLQSYAWALKVFLNFMNRKAPLTILTDENMYLKEAIEKELPGTKQALCIWLIAARFPSWFDAVLGERYNSWKDEFDRLYNMESTMEFDLGWSDMMNSYGLHGNGHIASLFASRTLWALPYLRGQFFAGLLASPETSKSISVFIQRFSSAQTRLAHFIEQVAVVAEYKDQAGRQQMMQHNLQSITLKTATPMERHAAAVLTPYAFSKLQDELVVACQYASFHLEGNVFLVRHHTKTEDGGCNVTWSQREELISCSCNMFESAGILCRHGLRVLSTLNYFQIPDHYLPPRWRRTWPSPSKALNGAYFHESPEIGRVKALQSMVSALVSEASKSTERMDIATREVSALLSRMRQQPVVMHVSGDGVHK

SEQ ID NO: 18603 - protein, 337 aa, Triticum aestivum
  misc_feature (100)..(100): Xaa can be any naturally occurring amino acid
  misc_feature (282)..(282): Xaa can be any naturally occurring amino acid
  misc_feature (299)..(299): Xaa can be any naturally occurring amino acid
  unsure (1)..(337): unsure at all Xaa locations
MANIDMAAVLADLERDAAADARTPRTKLVCTLGPASRSVPMLEKLLRAGMNVARFNFSHGTHEYHKETLDALRQAMHNTGILCAVMLDTKGPEIRTGFLXDGKPIKLTKGQEITVSTDYDIKGDTNTISMSYKKLPQDVKPGHVILCADGTISLAVLSCDPAAGTVRCRCENTAMLGERKNCNLPGIVVDLPTLTEKDKEDILEWGVPNDIDMIALSFVRKGSDLVTVRQLLGQHAKRIKLMSKVENQEGIVNFDDILRETDAFMVARGDLGMEIPVEKIFXAPKMMINKCTLPGKPVXTATKMLDSMIKSPRPPGAEATDVQNAGVEWTQWVMPQG

SEQ ID NO: 18604 - protein, 438 aa, Bacillus cereus ATCC 10987
MHHDEKNKIGLTVALSIVVGTIIGSGVFMKPGSVLDYSGSSNMAILAWVIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISENQSIGMAILATLFAYDGWILLASIGGEMKNPTKLLPKAMTVGILIVTAAYVLINLALLNVLPATQIVDLGENATATAAGMLLGEYGGKIISIGIIVSIFGCLNGKILTFPRIPMSMAERGQLPFAKFIAKESPRFKTPANAITVEIILGIILMIISDPNKLSEISVFIIYIFYVMTFIGVFILRKRNKNKERAYSVPLFPIVPIVAIFGSLFVIGSAIINDPVSCFLSIGIVFTGLPVYWYLNKKNKNEVS

SEQ ID NO: 18605 - protein, 146 aa, Zea mays
  misc_feature (56)..(56): Xaa can be any naturally occurring amino acid
  misc_feature (90)..(90): Xaa can be any naturally occurring amino acid
  unsure (1)..(146): unsure at all Xaa locations
SARATPPYIFQLPLSVAAVDSTFIMIKPDGVQRGLIGEIIIRFEKKGFYLMALRLXNVPRSFAEKHYANLASKPFFQGLVDLLSSTGPLXEPVVMGSGTDAVYHILDPKIIGSTNPLASVPGNIRDNFAVDIGKHVIHGSDSIESA

SEQ ID NO: 18606 - protein, 332 aa, Arabidopsis thaliana
  misc_feature (78)..(78): Xaa can be any naturally occurring amino acid
  misc_feature (94)..(94): Xaa can be any naturally occurring amino acid
  unsure (1)..(332): unsure at all Xaa locations
MDIDASCSLVLYGKSSVETDTATRLKNNNVLTLPDNSKVSIFLQSEIKNLVRDDDSSFNLSLFMNSISTHRFGRFLIXSPYLSSTHDVVSHFFXNFSEIPVGSVCVSDIQLKGRGRTKNVWESPKGCLMYSFTLEMEDGRVVPLIQYVVSLAVTEAVKDVCDKKGLSYIDVKIKWPNDLYLNGLKIGGILCTSTYRSRKFLVSVGVGLNVDNEQPTTCLNAVLKDVCPPSNLLKREEILGAFFNKFENFFDLFMEQGFKSLEELYYRTWLHSGQKVIAEEKNEDQVVQNVVTIQGLTSSGYLLAIGDDNIMYELHPDGNSFDFFKGLVRRKL

SEQ ID NO: 18607 - protein, 1194 aa, Magnaporthe grisea 70-15
MPKRTVNGLAGSPAHKRTRFEQDEDEVVDTAESSSARRNESVSSSEAPDIEVLEIALEAAFTDDDKQRKRVRLSTPEDVKPIIPSHSSRRAPNPSNDDEEEDGEEEDFNMEDEGEGDLVAGTQYEMLRDKEFAHLQHEKEDDQRATQRLRSRPNIVGQNHTAENGILLRVECVNFMCHERLNVELGPLMNFIVGENGSGKSAILTAITVCLGGKASSTNRAGSLKALVKSGQQQAILSVTIKNEGLDAFQHDIYGDSITVERHFSTTGSSGFKVKSKSGRIIGTKKALVEEIVEYFCLQVDNPLNVLSQDQARSFLNSASDSEKYQFFIMGVQLEQLDNDYRLVNEFVESARSKIPEQEERVVLTKKKYEEAQKLHESMKQNEELRRKRRLYAQQLAWAQVQDQEKILEGRHDKVRDVNDRIRAQELEIERKSAAFDAADRTYERAVAEAERMAEEEPEAAAMTDAAQEKFDAARRELERIRQDERDAHTQLKHHDKALKANAASIEQEKKIVAGSTGEEVTRNRDRLAAEKDRLEQIRERLNENAARGPGLEQLRDDAKNEQIKMHRAAEAKQQEIRAQEGKIRDLERNDRSPLDGYEPRVPELLRQIASDSGYREKPIGPMGSLIRLHKPEWSSLLEKTLGQQLNAFVVTSKADQQRLQTTMRRLGIQRCPIAIGNRAPLNTADKEPDTEFDTILRVLKFDDDLIRNQLIISGSIEQVILIPDRKAAEKAMFDGPPPRNVKACLSFNERTKSRGYRLTARQGGQNLSTSQVNPNPGTKPRMKADAHAQIAQEREYLAQLKDEYTRLCQKRDDQRRKVQQCEQELQQQRQTKTELHREERQCEASILGIERDLDQFEGYDARLQGLEEARARLQEEFETVGRQYGELRAIMDEQNKKVQALHAELAKEKATRDQFMARRGRAMDKIKGYADGRAMELSQKNAAMEEMEKLKDDLRRAERKVGEQETIVQEFTTEASKIFPERVFVPEGETHQAVQKKLDIVKKQLDDRNKRIGKTEAQVEAEAATAKKNFEHASKSLKGSLQVIKQLKRTMALRLEKWRLFQRYISASARTNFIYLLSERGYRGQLLLDHVNRKLQIQVEPDATKKNGQGRNTKTLFWWREVLFFHLPVAGNMGFHGAISTNMLVSAARRSVSRQYIMITPNAIEGRAKVDKDVKIHRMTDPRQRTLAGPQAR

SEQ ID NO: 18608 - protein, 426 aa, Pseudoalteromonas tunicata D2
MTISQDLFERALASIPGGVNSPVRAFNGVGGTPLFITKAQGAYTFDADGNKYIDYVGSWGPMIMGHNHPAIKNAVLAAVENGLSYGAPTETEILMAEKVKALVPSIEKVRMVSSGTEATMSAIRLARGFTGRDKILKFEGCYHGHADSLLVKAGSGALTMGVPNSPGIPADFAKHTLTVSFNNLDEVKAIFEKYADEIACIIVEPVAGNMNCIPPVAGFLEGLRAVCDQYKSVLIFDEVMTGFRVALGGAQQYYNIVPDLTCLGKVIGGGMPVGAFGGKKEIMDFIAPVGPVYQAGTLSGNPIAMAAGLAALELISAPGLHADLEAKSKRLCEGFEQAAAEAGIALTTNYAGGMYGFFFTDAAKVTSYQQATQCDVERFKRFFHLMLEEGVYLAPSAFEAGFICSEHGDAEIEQTIAAAKRAFAKL

SEQ ID NO: 18609 - protein, 469 aa, Pseudomonas syringae pv. syringae B728a
MSETTSPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPDIPGWVSAAAFFVLINAINLTNVKVFGETEFWFAIIKVVAIIGMIALGSYMLVSGSGGPQASVSNLWEHGGFFPNGVSGLVMALAIIMFSFGGLEMLGFTAAEAEQPKTVIPKAINQVIYRILIFYIGALVVLLSLTPWDSLLASLNASGDSYSGSPFVQVFSMLGSDTAAHILNFVVLTAALSVYNSGTYCNSRMLVGMAEQGDAPRALAQVDKRGVPVKAIFASAAVTLVAVLLNYFVPQQALELLMSLVVATLVINWAMISYSHLKFRQHMNRTAQVPLFKALWYPYGNYVCLAFVVFILGIMLMIPGIQISVYAIPVWLAVMWVCYRAKNRRSVVVPAESGK

SEQ ID NO: 18610 - protein, 340 aa, Saccharomyces cerevisiae
MTAPLVVLGNPLLDFQADVTAEYLAKYSLKENDAILVDAKSGDAKMAIFDELLQMPETKLVAGGAAQNTARGAAYVLGAGQVVYFGSVGKDKFSERLLNENEKAGVKSMYQVQNDIGTGKCAALITGHNRSLVTDLGAANFFTPDHLDKHWDLVEAAKLFYIGGFHLTVSPDAIVKLGQHAKENSKPFVLNFSAPFIPHVFKDALARVLPYATVIIANESEAEAFCDAFQLDCANTDLEAIAQRIVKDSPVEKTVIFTHGVEPTVVVSSKGTSTYPVKPLDSSKIVDTNGAGDAFAGGFMAGLTKGEDLETSIDMGQWLAALSIQEVGPSYPSEKISYSK

SEQ ID NO: 18611 - protein, 332 aa, Nostoc sp. PCC 7120
MKPKVVITNWVHPEVIELLKPSCEVIANPSKEALSREEILQRAKDAEALMVFMPDTIDEAFLRECPKLKIIAAALKGYDNFDVAACTHRGIWFTIVPSLLSAPTAEITIGLLIGLGRQMLEGDRFIRTGKFTGWRPQFYSLGLANRTLGIVGMGALGKAIAGRLAGFEMQLLYSDPVALPPEQEATGNISRVPFETLIESSDFVVLVVPLQPATLHLINANTLAKMKPGSFLINPCRGSVVDEQAVCKALESGHLAGYAADVFEMEDWYRSDRPHNIPQPLLENTKQTFFTPHIGSAVDELRHNIALEAAQNILQALQGQKPQGAVNYLRES

SEQ ID NO: 18612 - protein, 569 aa, Shigella flexneri 2a str. 2457T
MSEEKLGQHYLAALNEAFLGVVLDHAWQTKDQLTVTVKVNYLPEVVEFLYYKQGGWLSVLFGNDERKLNGHYAVYYVLSMEKGTKCWVTVRVEVDANKPEYPSVTPRVPAAVWGEREVRDMYGLIPVGLPDERRLVLPDDWPDELYPLRKDSMDYRQRPAPTTDAETYEFINELGDKKNNVVPIGPLHVTSDEPGHFRLFVDGENIIDADYRLFYVHRGMEKLAETRMGYNEVTFLSDRVCGICGFAHSTAYTTSVENAMGIQVPERAQMIRAILLEVERLHPHLLNLGLACHFTGFDSGFMQFFRVRETSMKMAEILTGARKTYGLNLIGGIRRDLLKDDMIQTRQLAQQMRREVQELVDVLLSTPNMEQRTVGIGRLDPEIARDFSNVGPMVRASGLARDTRADHPFVGYGLLPMEVHSEQGCDVISRLKVRINEVYTALNMIDYGLDNLPGGPLMVEGFTYIPHRFALGFAEAPRGDDIHWSMTGDNQKLYRWRCRAATYANWPTLRYMLRGNTVSYVPLIIGSLDPCYSCTDRMTVVDVRKKKSKVVPYKELERYSIERKNSPLK

SEQ ID NO: 18613 - protein, 346 aa, Caulobacter crescentus CB15
MKALRYHGARDVRYESMDDPTPQSDRDAIVQVTACSICGSDLHIYHGHGFSEDLGFCVGHEAVGEVVEVGRGVQRLKVGDKVMLPAAVGCGRCRSCLSGVIQTCENGQGACYGLSARLQGSQAEAVRVPAADMNAVPVPDGVSMDQALMMTDALATAWFGARNAEVRPGASVAVIGLGPIGLMAVESAYVMGAHVVYAIDPLPARRALAEEAGAIALHPDEALARVREDTKGRGLDCVIEAVGGEATVDAALRLVRPRGVVSVIGVQQAKRFAFPLERAFGAGLTFRVGTCSVPEELPALFPLVRSGRLRPEKYISHRLPLSDGPEAYRLFESREAGALKMVLTPG

SEQ ID NO: 18614 - protein, 632 aa, Zea mays
MDRDEEVGHGDRSLLFIGDEDDLGVDRDGGSPPTSSDDGSFSDRSDAETRAGHVRRRDGGEREDTPEDGQNGAWPQSYRFVNQPPRRPHLFHDSELTPFPRRRSRFACRQSIDMLSAVPSPTMNSIMAASPSLTRFGSSFLKAGSSFFLRKGEGSGLPLTRPLLPPSLPQLSQSSLHPQPRPVKQSTDSLAQAPRWPAAHEAELPERPSRQCLKSDYIELPPPASKCSRNQSIINGVRVISLWNQSSMLVEFLGFNVLCGVGILTTAYGIKEGGWLSLLLLPLLGGSSCYTGLLLKRCIDSSPNIETYPDIGQVAFGIFGRIFVSVVLYMELYASCVEYITLLGDSLSSVFPSAHLAFTGIDLNAHNLFATTMALAILPSVWLRNLSLLSYLSAGGVIATITVIVCLCWVGIGEGIGFRFSGAVVNVTHLPVALGLYGYCYSGHSVFPNIYSSMKERSQFPFVLMFCFTVVTLVYAGVAVSGFLMFGESTMSQFTLNLPQQYIPSKIAIWMTVVNPYTKYALTMTPVALSIEEALPKKMQSYLVGMLVRTCLVLSTVAVALLFPYFALVMALLGSVFTMLVALILPCACYLSIKKGAVPLWEIILCIIIIAIGVVCACIGSFTSINQMISSR

SEQ ID NO: 18615 - protein, 474 aa, Bacillus cereus E33L
MAQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGLIDLKGDEPAPLFSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYVADGGKLEDLKFKTPLYPLVPMLGFGLYGIILISLIFIPEQRLGIYCTVPFIIFCYTYYHFKVKKRISTNTSSENKISETI

SEQ ID NO: 18616 - protein, 375 aa, Pinus banksiana
QVIKCKAAVAWAAGEPLKIEEVEVAPPQAMEVRIKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARIAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYMDKKLELEKFITHEVSFADINKAFDYMIKGESLRCVINVIGN

SEQ ID NO: 18617 - protein, 259 aa, Neisseria meningitidis MC58
MKEHKARKRFGQNFLQDTRIISDIVNAVRPQADDVVIEIGPGLAAITEPLAKKLNRLHVVEIDRDIVCRLKTLPFADKLVIHEGDVLQFDFNGIAGKKKIVGNLPYNISTPLLFKLAEVADDVVDMHFMLQKEVVERMVAAPKSNDYGRLGVMLQYFFDMEMLIDVPPESFDPAPKVDSAVVRMIPVKHRIGKADDFEHFAKLVKLAFHQRRKTIRNNLKELAGDDDLQAVGINPQDRAEHIAPEKYVALSNYLAGKVV

SEQ ID NO: 18618 - protein, 173 aa, Zea mays
  misc_feature (12)..(12): Xaa can be any naturally occurring amino acid
  misc_feature (33)..(33): Xaa can be any naturally occurring amino acid
  unsure (1)..(173): unsure at all Xaa locations
QKILRKQQMYSXFRDKLNACQKALDLRWKSFQXNAGLLKRQLTWLFNEHLGKKGISGHINVDYKNEVLSVELTMPQDASRDTIRDTRGLSGGERSFSTLCFTLSLHGMAEAPFRAMDEFDVFMDAVSRKISLDTLVDFAVAQGSQWIFITPHDISMVKAGDRIKKQQMAAPRG

SEQ ID NO: 18619 - protein, 272 aa, Bacillus cereus E33L
MDKQIGFIGCGNMGMAIVGGMLNKKIVSSNKIMCSDLNTTNLENASEKYGISITTDNKKVAKNADILILSIKPDLYTAVINEIKEVIKNDAIIVTIAAGKSIESTENAFNQKLKVVRVMPNTPALVGEGMSALCPNEMVTEKDLEEVLNIFNSFGQSEIVSEKLMDVVTSVSGSSPAYVYMIIEAMADAAVLDGMPRNQAYKFAAQAVLGSAKMVLETGIHPGELKDMVCSPGGTTIEAVATLEEKGLRTAIISAMQRCTQKSVELSGQTKK

SEQ ID NO: 18620 - protein, 136 aa, Magnaporthe grisea 70-15
MTGGGKSGGKASGSKNAQSRSSKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQNLLPKKTGKTAGGKNASQEM

SEQ ID NO: 18621 - protein, 489 aa, Magnetospirillum magnetotacticum MS-1
MILKDSSLLKSRAFVNGAWTDADNGATFDVLNPATGEILASVPDMGAAEARRAIEAANAAWPAWKAKTGKERGAILRNWFNLIMAHQEDLAVLLTAEQGKPLAEARGEIAYGASFIEWFAEEAKRVYGDTIPGHAPDKRIVVVKEPIGVVAAITPWNFPNAMITRKCAPALAVGCPVVVKPAEDTPLSALALAELAVRAGIPAGIFNIVTARHGALVGGELSGNPLVRKLSFTGSTQVGKLLMSQCAATVKKVSLELGGNAPFIVFDDADLDAAVAGAMASKYRNAGQTCVCANRMLVQDGVYDEFARRLAKAVSQLKVGDGLASDANQGPLINAKAVEKVERMLADAVSKGATIVCGGKRHALGRTFFEPTIVTNVTSTMSMAREEIFGPVAPLFRFKTEAEAIAMANDTEFGLAAYFYAGNIARVWRVAEKLEYGMVGINDGIISTEVAPFGGVKESGIGREGSKYGIEDFLEIKYLCLGGIKEAAQ

SEQ ID NO: 18622 - protein, 492 aa, Debaryomyces hansenii CBS767
MSKPTLNNPDLIRTKPYINGEWFESKSTKTFKVIDPATETEIVELPDQTPEEIAFAIEKAEEAFKTFKKTNAYDRARWLRKLNDLMLENIEDLAKILTWENGKCLTDATGEIKYAASYFEWFAEEAKRIYGNTIQPSNNNNKVITYKQPIGVVGLLCPFNFPTAMGARKLAPSFAAGCTTILKPDGQTPLSSLALAYLAEKAGFPKGTFNVVLASTENTPKVGLEFCESPRIKKISFTGSTPVGKLLMRQSSSTLKKLSMELGGNAPIIIFDDADLDLAVEQSIASKFRSLGQTCVCANRLYIQSGVYDKFCEKFTEKVKEFKIGNGLEKGITHGCLINDKAITKVEEHIKDAVGKGAKVLVEGGRLPNLGKNFYAPSVVKDVTQEMVVVKEETFGPLAALLKFDTKEQVLDWCNDTPYGLASYVFSENLNTIWFMSEYLESGMVAVNTGLFTDAAMPFGGVKESGFGREGSLYGIDDYTVVKAITLGNMYR

SEQ ID NO: 18623 - protein, 334 aa, Prosthecochloris aestuarii DSM 271
MTKVKVGINGFGRIGRLVFRQALANDKIEITAINDLCDTKTLAHLLKYDSTHGVFNAEVSVEDDKLIVNGKSILICSEKDPAQLPWKELGIDLVVESTGLFTKRAAAAKHLEAGAKKVIISAPAKDAVDATIVVGVNDDIITGEEEIISNASCTTNCLAPMAKVLEDNFGIEKGFMTTVHAVTNDQRILDLPHSDLRRARTAMSSIIPTSTGAAKAIGLVVPELAGRLDGMAMRVPVPDGSVTDLTVILKKPATKEEINAAIQAAAEGNMRGVLEFCTDPIVSQDIVGNANSCIFDSLLTMSTGTMVKVVGWYDNELGYSTRVIDLLEIYSHFV

SEQ ID NO: 18624 - protein, 364 aa, Glycine max
MGKGGMSIDEHGEGKEENMAAWLVGMNTLKIQPFKLPTLGPHDVRVRMKAVGICGSDVHYLKTLRCAHFIVKEPMVIGHECAGIIEEVGSQVKSLVPGDRVAIEPGISCWHCNHCKHGRYNLCDDMKFFATPPVHGSLANQIVHPADLCFKLPDNVSLEEGAMCEPLSVGVHACRRANIGPETNVLIMGAGPIGLVTMLAARAFGAPKTVIVDVDDHRLSVAKSLGADDIIKVSTNIKDVAEEVVQIQKVMGAGIDVTFDCAGFDKTMSTALSATQPGGKVCLVGMGHSEMTVPLTPAAAREVDVVGVFRYMNTWPLCLEFLRSGKIDVKPLITHRFGFSQKEVEEAFETSARGGNAIKVMFNL

SEQ ID NO: 18625 - protein, 564 aa, Oryza sativa
MSVLIVTSVGDIEVDLHTDMCPLTTKNFLKLCKMKYYNGCLFHKVEKDFLAQTGDPTGTGAGGDSVYKFLYGDQARFFDDEIRPDLRHSKKGTIAMASAGENCNASQFYITLRDDVDYLDDKHTVFGMVAEGFDTLTKISETYVDDKGRPFKDIRIKHTYVLDDPFDDPPQLSELIPENSPVGKPQDEIAEERLEDSWVPMDEMVAPEELEEMIRSKEAHTNAVILESVGDIPDAEIKPPDNVLFVCKLNPVTQDEDLYTIFSRFGTVTSAEIIRGYKTGDSLCYAFIEFETKEACERAFFKMDNCLIDDRRIHVDFSQSVSKLWGQFRQSKRNANKDGCFKCGAPDHIAKDCDQGTEQKNKGPSYVLKDENTQRGGNNRRSYDLVFDEDGENYTDQQDPGSTGRRKIQRTDDRKSGLPPRGDHDRISRERTHSDENGREGGKEGDRDRGIRKHEDYHRYNKSGERSSSRYDDRGYSKHESRGKYRDGNDDYRRQPGGGSRYGRDKYEGERRYREDDGHGRSDRHKRDESDNRKRSPDTGKHRREDGGHRETSKHRERRQRDDR

SEQ ID NO: 18626 - protein, 197 aa, Brassica napus
  misc_feature (18)..(18): Xaa can be any naturally occurring amino acid
  unsure (1)..(197): unsure at all Xaa locations
MEQSTRSLIITIVITSMXLVGFGSSDLDQDREECTNQLVVLSPCLTYVGGNAKAPTKDCCGGFGQVITQSQKCVCILVKDKDDPNLGLKFNASLAAHLPTACHITAPNITKCISLLHLSPNSTLAREFESLGRLEASANSAPPLQNVTDGAGGGKAESVKSDGGKKKKSWLAVELLIFALFSHLLLVISSFTSSSFI

SEQ ID NO: 18627 - protein, 502 aa, Arabidopsis thaliana; identical to SEQ ID NO: 268

SEQ ID NO: 18628 - protein, 468 aa, Burkholderia sp. 383
MVVQGSGNAVTQQQRSFDDIVAREQGLRHALTSGQMAMIAIGGAIGTGLFLGSGFAIGLAGPSVLVSYAIGALIALLLMGALAEMTVAHPTAGSFGAYAEHYVGPLAGFLVRYAYWFAVVFAIGTEISAIAVFMKYWFPAVPGWYWVIGFSALLIAVNLASVTLYGTVEYAFSLLKIAAIVVFIVLGAYLVWSAPAASGVGFANYTAHGGFMPKGPWGTWVAVIVAIFSYMSIEAVAIAAGEARDPQHAVTRAFRSTVFRLVLFYLLTLSLMLAIVPWTQAGTDESPFVKVMAATHVPYAAGVINFVLLIAALSAMNSQLYVTTRMMFSLSRARLAPAVFGRLGTNGVPRAALWISTSGVAVAAVLVALAPDTAFTVMMAIAMFGALFTWLMIFVTHLRFRSRYRGPALAFRMWGHPFGSLLGAGLVAAILFTTAFTREFRMTMVVGVVFAVLLTLAYALHYRHQHAR

SEQ ID NO: 18629 - protein, 1100 aa, Rhodopseudomonas palustris CGA009
MNKMTSIAPSDRPDAETSDELWYKDAIIYQLHVKAFADSNNDGIGDFAGLTEKLDYLQELGVNTLWLLPFYPSPQRDDGYDIADYGSINPDFGTMKDFRRFIVEAKKRNLRVITELVINHTSDQHAWFKRARRSPKDSSARDWYVWSDTDQKYLGTRIIFTDTEKSNWTWDPEAGQYYWHRFFSHQPDLNFDNPRVVSAVVKVMKRWLDTGVDGFRLDAIPYLCERDGTNNENLPETHAVIKRLRAELDAYAKGKLLLAEANQWPEDVQQYFGDGDECHMAYHFPLMPRIYMAIAQEDRFPITDIMRQTPEIPANCQWAMFLRNHDELTLEMVTDVERDYLWKTYAADPRARINVGIRRRLAPLMDNDRRKIELMNSLLMSFPGTPIIYYGDEIGMGDNIYLGDRNGVRTPMQWSPDRNGGFSRADPARLYAPPIMDPVYGYASVNVEAQQRSLSSLLSAMKRLIAVRKSTPAFGRGSITFIRPSNRAVIAYVRQYKDEVILCVANLSRAAQATELDLSPWKDRVPQEMLGRTKFPPIGDPAYMITLAPFGFYWFKLQEPGTAAHVAPVSTVPEFVTLVVPLGSTWMTLGRTRSMFEHEVLPTFLSRTRWFPERNPRAIHPRLTSAIPFANDGDNRPWLAFFEATQRGTTARYLLPMQIDWVRFDRERYNPRAYAAVRQGAREGTLLDVAADPSFIDLLLENVRDAVTVTGDNGDRLEFRPGSKLAERPAGPFQNIRAVETEQSNSTALVDGDYVVKLYRRLQIGINPELEMGRFLTEVAGYANTPALLGSVELIEGDKTSAVAVVHEFARNQGDGWTVTSGYLDRYIDEQRVLSRAEEKTESDQLAPYLHFMQQTGKRVAEMHIALASHPEVPDFAPEPITLDASRDWAETVAASADRMLDELRRRRDTLKEGDRTLVDELLAARDVLMSRIHGLLGDDGGLNIRHHGDFHLGQMLIVKDDIYIIDFEGEPRRTLDERRAKAPAARDVAGLIRSIDYSTTAALERALKAASDEPGRLTEALDLWRIRATGAFLDAYRQTMGDSPVWPADIAAADRVLDFFLIEKALYEIDYEIAHRPDWVHVPLVGILRILSPPPEELP

SEQ ID NO: 18630 - protein, 91 aa, Zea mays
  misc_feature (24)..(24): Xaa can be any naturally occurring amino acid
  misc_feature (75)..(75): Xaa can be any naturally occurring amino acid
  unsure (1)..(91): unsure at all Xaa locations
MEQTFIMIKPDGVQRGLIGDMISXFEKKGFYLKGMKLMNSERAFAQQHYADLYDKPLFTRLNRYIMSGPVVAMVXEANDIMLTGRRIIGAT

SEQ ID NO: 18631 - protein, 472 aa, Dechloromonas aromatica RCB
MHRNRNAKIVATLGPASSDRDTIQKLYLNGADIFRLNFSHGTHEDHKRSLETIRDVEREAGRPIGVLLDLQGPKLRLGKFANGPITLAEGDKFRLDLDCDRPGDQTRAPMPHPEIFKALSVQSSLLIDDGRIRLFVEKCGPDFAETRVVAGGTLSDRKGVNVPGSLIPMSAMTDKDRADLDFGLTLGVDWVALSFVQRAEDILEIKKIIDGRAGVIAKLEKPAAIERLEAIVNVSDAIMVARGDLGVEMPPEQVPAIQKRIIRACRSAGKPVIVATQMLDSMVAAPVPTRAEASDVATAIYDGADAVMLSAESASGKYPVAAVKMMDSIISRTESDPYYRVAIDASQPPARANKADAIGSAVRHVADLLHIAVTVAYTSSGTSALSMARERPKAPIIALTPRLATARRLSLAWGLHAVMCHDVVDVTEMTDLACETARRQHFASRGQSVVISAGMPFGRSGTTNLLRIAELS

SEQ ID NO: 18632 - protein, 86 aa, Triticum aestivum
LSGGERSFSTLCFALALHGMIEAPFRAMDEFDVFMDAVSCKISLDTLVDFAVAQGSQWIFITPHDISIVKPGDHKWKIAPVCYCAQ

SEQ ID NO: 18633 - protein, 218 aa, Pseudoalteromonas tunicata D2
MTQDEMKKAAAWAALEYVEKDSIIGVGTGSTVNHFIDALGTIKGDIRGAVSSSEASTEKLKALGIEIFELNDVDGLSVYVDGADEINPANEMIKGGGAALTREKIVAAVAKKFVCIVDSSKQVDVLGNFPLPVEVIPMARSYVARELVKLGGDPMYRQGVVTDNGNVILDVFNLQISQAKQLEQQINQIVGVVTNGLFAARGADVVIVGTPDGPKILK

SEQ ID NO: 18634 - protein, 410 aa, Pseudoalteromonas tunicata D2
MSNKVSLAKDKIKILLLEGLHQSAVETLKRHGYSNIEYVKTSLAEEELIERISDVHFIGIRSRTHLTEKVLNAAEKLIAVGCFCIGTNQVELDAAKARGIAVFNAPFSNTRSVAELVLGEILLLLRRIPQKNAQAHRGIWDKSAHGSFEARGKTLGIIGYGHIGTQLGIMAENIGMNVQYYDIEDKLSLGNATQVHHLTQLLQTSDVISLHVPETPQTKNLIGAAELEIIKHGAILINASRGTVVDIDALASSLRENKLSGAAIDVFPTEPTSNDEEFISPLREFDNVILTPHIGGSTQEAQENIGIEVAGKLAKYSDNGSTLSAVNFPEVSLPELAGRSRLLHVHHNRPGILTQINQAFAQHGINIAAQYLQTNETIGYVVIDVDTDDSEIALKELRAVEGTIKARILH

SEQ ID NO: 18635 - protein, 344 aa, Zea mays
MASSGYEGILLGMGNPLLDISAVVDEGFLAKYDVKPGNVILAEDKHLPMYDELASKSNVEYIAGGATQNSIRVAQWMLQIPGASSYIGCIGKDKFGEEMKKNAQAAGINAHYHEDDNAPTGTCAVCVVGGERSLIANLSAANCYKSEHLKKPENWALVEKAKYIYIAGFFLTVSPDSIQLVAEHAAATNKVFMMNLSAPFICEVFRDAQEKALPYVDYIFGNETEARTFAKVRGWEIENVEEIALKISQLPKASGTHKRITVITQGCDPVVVADDGKVKTFPVILLPKEKLVDTNGAGDAFVGGFLSQLVQEKSIDECVRAACYAANVVIQRSGCTYPEKPDFN

SEQ ID NO: 18636 - protein, 247 aa, Methanococcus maripaludis S2
MTTDSKNARNSEVKIQGDEKISNVEKAIDALKSGKMVLLYDSDDREGETDMVVASEFITPEYIREMRKNAGGLICTCLHSDFCDKLGIPFMVDILDVASEKYPVLKELYPNDIPYDEKSTFALYANHRTTFTGITDNDRALTVKKITELCSEERFKDFGKEFRCPGHVAFLRATEGLVKNRQGHTEMTVALAEMAGLTPITTICEMMGDNGKAMSKDLVKKYAEENGLVTINGQELIEYYLKEFSKE

SEQ ID NO: 18637 - protein, 337 aa, Zea mays
MGKIKIGINGFGRIGRLVARVALQSEDVELVAVNDPFITTDYMTYMFKYDTVHGHWKHSDITLKDSKTLLFGQKPVTVFGIRNPEEIPWGEAGADYVVESTGVFTDKDKAAAHLKGGAKKVVISAPSKDAPMFVVGVNEDKYTSDINIVSNASCTTNCLAPLAKVIHDNFGIIEGLMTTVHAITATQKTVDGPSAKDWRGGRAASFNIIPSSTGAAKAVGKVLPDLNGKLTGMSFRVPTVDVSVVDLTVRIEKGASYGDIKKAIKAASEGPLKGIMGYVEEDLVSTDFVGDSRSSIFDAKAGIALNDNFIKLVSWYDNEWGYSNRVVDLIRHMFKTQ

SEQ ID NO: 18638 - protein, 321 aa, Candida sp. GCY 2005
MTTSSTIKLNSGYEMPIVGFGCWKVTNETAADQIYNAIKIGYRLFDGAQDYGNEKEVGEGINRAIKDGLVKREELLITSKLWNNFHDPKNVELALDKTLSDLNLGYLDLFLIHFPIAFKFVPIEEKYPPGFYCGDGNNFHYENVPLLDTWKALEKLVQKGKIRSIGISNFTGALIYDLIRGATIKPSVLQIEHHPYLQQPKLIEYVQKQNIAITAYSSFGPQSFLELESKRALDTPTLFEHKTIKSIAEKHGKTPAQVLLRWATQRNIAVIPKSNNPARLAQNLSVVDFDLSKEDIQEISALDIGVRFNDPWDWDNIPIFV

SEQ ID NO: 18639 - protein, 217 aa, Shewanella sp. MR-7
MNQSLLAPFGTAIERVEAGLEALRQGQGVLVVDDEDRENEGDLIFAAESLTNAQMAMLIRECSGIVCLCLPDEKVKALELPPMVENNSSQYGTAFTVSIEAKVGVTTGVSAADRVTTIKAAIADNAKPSDLARPGHVYPLRAQPGGVLTRRGHTEGTIDLMQLAGLKPAGVLCEVTNPDGTMARLPEIIAFGAAHNMPVLTIEDIVVYRKSLLANVG

SEQ ID NO: 18640 - protein, 343 aa, Burkholderia pseudomallei K96243
MKALAKLERGPGLTLTRVKKPEVGHNDVLIKIRRTAICGTDIHIWKWDDWAQKTIPVPMHVGHEYVGEIVEMGQEVRGFSIGDRVSGEGHITCGFCRNCRAGRRHLCRNTVGVGVNREGAFAEYLAIPAFNAFKIPPEISDDLAAIFDPFGNATHTALSFNLVGEDVLITGAGPIGVMAVAIAKHVGARNVVITDINDYRLELARKMGATRAVNVSRESLRDVMADLHMTEGFDVGLEMSGVPSAFTSLLESMNHGGKVALLGIPPAQTAIDWNQVIFKGLEIKGIYGREMFETWYKMVAMLQSGLDLSPIITHRFAVDDYEKGFAAMLSGESGKVILDWADA

SEQ ID NO: 18641 - protein, 360 aa, Clostridium perfringens ATCC 13124
MDIIGSINTRFLSKSEQSKNEIFNKIDNIVKGGGNIIRMNLSHGKHRDVECCIDYIRSNHKNVKILLDLQGNKIRVANNIYGTFKVNSGDLVYFCSEETYDVYLKNIDRNKLIPLNIKNKFIYNNTFKKIYMKDATMEFIVISNNNGLIKTKVKLGGVVRKEKGCNLPNLDRKNWGVSEKDLEDIRFALDNKVDIIDYSYCSYMEECREFKNIVFKNLKSNQFIPKLWGKIETNEGINNIKEVAKELDGIVIARGDLTAEIGILNVPIVQEKILYALKNENKSIIVATNVLSSIRNKQNKPTINELSDIYHFIRCGATGFMLTGETSTGENEEYVVTTLKNSIKYYEKLLSKIKKRSKRV

SEQ ID NO: 18642 - protein, 433 aa, Streptococcus pyogenes MGAS315
MNEKVFRDPVHNYIHIDNPLIYDLINTKEFQRLRRIKQVPTTAFTFHGAEHSRFSHCLGVYEIARRVTAIFEEKYADIWNKDESLVTMTAALLHDIGHGAYSHTFEALFHTDHEAFTQEIITNPETEINAILVRHAPDFPDKVASVINHTYPNKQVVQLISSQIDCDRMDYLLRDSYFSAANYGQFDLMRILRVIRPVEDGIVFEHSGMHAVEDYIVSRFQMYMQVYFHPASRAVELILQNLLKRAQHLYPEQQAYFQKTAPGLIPFFEKKANLADYIALDDGVMNTYFQVWMASEDHILSDLASRFINRKILKSVTFDQDSQGELERLRQLVESVGFDPDYYTGIHINFDLPYDIYRPELENPRTQIEMIQKDGSLAELSQLSPIVKALTGTTYGDRRFYFPKEMLELDDLFAPSKETFMSYISNGHFHFSQ

SEQ ID NO: 18643 - protein, 439 aa, Glycine max
MKFTPSSKFLGFSNHFHSLLAPSFSPTPKFSSSFSATMSTLSTQNDTVTHKTQQPLQIAKRLEKFQTTIFTQMSLLAIKHGAINLGQGFPNFDGPEFVKEAAIQAIRDGKNQYARGYGVPDLNIAIAERFKKDTGLVVDPEKEITVTSGCTEAIAATMIGLINPGDEVIMFAPFYDSYEATLSMAGAKVKGITLRPPDFAVPLEELKSTISKNTRAILINTPHNPTGKMFTREELNCIASLCIENDVLVFTDEVYDKLAFDMEHISMASLPGMFERTVTLNSLGKTFSLTGWKIGWAIAPPHLSWGVRQAHAFLTFATAHPFQCAAAAALRAPDSYYVELKRDYMAKRAILIEGLKAVGFKVFPSSGTYFVVVDHTPFGLENDVAFCEYLVKEVGVVAIPTSVFYLNPEEGKNLVRFTFCKDEETIRSAVERMKAKLRK

SEQ ID NO: 18644 - protein, 326 aa, Kineococcus radiotolerans SRS30216
MPRTRPDINVPALVGRHAVVTGASDGVGLALATRLAAAGADLTLPVRNQVKGRAALAAIRRAVPGARVVMADLDLSSLASVAAFGARMQEEGKAIHLLVNNAGVMTPPQRQSTVDGFELQFGTNHLGHVALVAHLLPLLRAGRARVTSQVSVAARSGRVNFEDPNWRDAYHGMKAYSSSMIAFGLFGLELERRSRAQGWGITSNLSHPGIAPTSLLAARPEVGRSADTTQVRRIRTLSRWGLVGTVETALLPALMAATSQESEGGKLYGPRGPGHLSGGPSEQKLYRPLRSTADAAHVWEISEALTGVSFPRSAADVLLAGQEKAS

SEQ ID NO: 18645 - protein, 423 aa, Legionella pneumophila subsp. pneumophila str. Philadelphia 1
MSIFRSVLITLLFISSAMAATPDQVTYLPGWGPIKNNQYAGYFPVNPKAGLFYWFVESNNPSMDAPIVLWLNGGPGAASLYGFFMENGPYQVDKNGKLTARKDSWTKAANYLVIDQPAGVGYSYGSSKSYGSEGEAIDQLQGALQLIFKKHPELYGKPLFLAGESYAGKYLPQLAIRLLKDKNMNLKGLLLGDPWINPRLQQKANIDYAYYHGLIDNKARKRVRVLYENCVKEIDKQSPSTSKANKTCEQIQEFIKQESGGLNLANIATGVEPEDTNMVNYLNQKVVREALHIPVTVSEFKTFSTAAAKKLEIGEQDSVADLYPQLLAAGIRILIYNGLEDGKDSNFLSTELLLASLDWHGKNAFAKAPTCIWRTNNEVSGYAKGAVGLTQVKIRGAGHLAPIDQPARVFDLFKHFINDKPLC

SEQ ID NO: 18646 - protein, 281 aa, Trichodesmium erythraeum IMS101
MTIQPRKRFAQHWLLSDKALNKIIQAAELSESDRILEIGPGTGVLTHRLLPLAASVVAVEIDRDLCQKLVKKFGRVKNFLLLQGDILSLDLETNLAQFIGFQNPHKVVANIPYNITGLILEKLLGTISQPLTNTYDLIVLLLQKEVADRICAKPDSKAYSSLSVKIQYLAKCEFICDVPAKAFYPPPKVDSAVIRLRPQLIEPQANNPKQMEMLVKLGFASKRKMLRNNLKAVVERDRLFELLENLKVNPQSRAEDLTVQEWVTLANSLEHFLHSHNKLLK

SEQ ID NO: 18647 - protein, 524 aa, Oryza sativa (japonica cultivar-group)
MRTSTSNAALLLLVAAAQCLALLSVAAAAKPRTRQGDYLDRLRGSPSSWASLAEDRGAPAPSPSPSGGRHAAPAAAAVGSKEADRVAGLPGQPAGVGFAQYAGYVTVDAAAGRALFYYLAEADGGAAASSKAPLLLWLNGGPGCSSLGYGAMEELGPFRVKSDGVSLYRNPYSWNNVANVMFLESPIGVGFSYSNTTADYSRMGDNSTAEDAYKFLVNWMERFPEYKGRDFYLAGESYAGHYVPQLAHAILRHSSAAAGGKPSSSPINLKGIMIGNAVINDWTDTKGMYDFFWTHALISDEANDGITKHCNFTDGADANSLCDDATSLADDCLQDIDIYNIYAPNCQSPGLVVSPPVTPSIESFDPCTDYYVEAYLNNPDVQKALHANITRLDHPWSACSGVLRRWVDSASTVLPIIKELLKNNIRVWVYSGDTDGRVPVTSSRYSVNQLNLPVAAKWRPWFSNTQGVGDVGGYIVQYKGNLSLVTVRGAGHEVPSYQPQRALVLVQYFLEGKTLPDCEKCGEA

SEQ ID NO: 18648 - protein, 464 aa, Lycopersicon esculentum
MAFFLIFLSSFFGLCIFCTALLRWNQVKYNQKNLPPGTMGWPLFGETTEFLKLGPSFMKNQRARYGSFFKSHILGCPTIVSMDSELNRYILVNEAKGLVPGYPQSMIDILGKCNIAAVNGSAHKYMRGALLSLISPTMIRDQLLPKIDEFMRSHLTNWDNKVIDIQEKTNKMAFLSSLKQIAGIESTSLAQEFMSEFFNLVLGTLSLPINLPNTNYHRGFQARKIIVNLLRTLIEERRASKEIQHDMLGYLMNEEATRFKLTDDEMIDLIITILYSGYETVSTTSMMAVKYLHDHPKVLEELRKEHMAIREKKKPEDPIDYNDYRSMRFTRAVILETSRLATIVNGVLRKTTQDMEINGYIIPKGWRIYVYTRELNYDPRLYPDPYSFNPWRWMDKSLEHQNSFLVFGGGTRQCPGKELGVAEISTFLHYFVTKYRWEEIGGDKLMKFPRVEAPNGLRIRVSAH

SEQ ID NO: 18649 - protein, 85 aa, Glycine max
VNRAQARMYVICTGHKYMVGFPTRKTNNDITCIVSNGGRVQCMQVWPPFGKKKFETLSYLGDADDAQSLEELQFRFRNEGSLAWI

SEQ ID NO: 18650 - protein, 120 aa, Trichodesmium erythraeum IMS101
MSQQSSKQPILEITVQELASRLINGIPENLQLVDVRERQEIEVAFIKGFKVLPLSEFHEWSEKIHLHLDSSQETLVLCHHGIRSAQMCQWLKNQDFTNVKNIIGGIDAYSSVVDQSIPRY

SEQ ID NO: 18651 - protein, 399 aa, Bacillus cereus ATCC 10987
MDTLIFEVGTALVLVAIAAVIAGKFKFSVIPFLIVLGMLVGPHAPTIGVIDFKFIESASVISFLGRIGVLFLLFYLGLEFSMKKLIKSGRSIAIGGTIYILINFSLGLLYGFIMGFPLLEILIIAGIITISSSAIVAKVLVDLRRTGNNETELILGIIMFEDIFLAVYLSVVSGLVLGDHASFLGALTSIGIALGYMLLFFIVARKATPLLNKLLNISSDEIFIIVVFASLFFIAGFSETIHVAEAIGALLLGLVFSETEHSDRIEHLVVPFRDFFGAIFFFSFGLSIDPFSLGGAIWLTLGAVLLTIIGNFIAGMIAGRQAGLSHKASTNIGLTIVSRGEFSIIMANIGIAGGLMSVLKPFSALYVLILSILGPLLTKESKNVYKFLNKIFKWDTKTN

SEQ ID NO: 18652 - protein, 582 aa, Debaryomyces hansenii CBS767
MAKKKKSNATNAARLLESSISPIVEIKYPEPLFTIAAHPTKPILLSGLATGHIYCSTYDADILEEAQSTKREKLSLLEKEAFKTGKIAHINRSVSQLKQKWWTVIEDNADIPDGSNIVNNWKTKRHKGSCRSAIFDPLENSLGENIYSVGTDHIIKKANTETGKVLSKATISEHYSDKNDAITKLVHSTSHPFLLSGTENGDVLVYDSNNMASNQLKFNVSKAHDDSINHILPMPAVSAYHYLTLGSTTLSHIDIRKGIITQSDDQEDELLSMCFASDHVNDNKNDTVLVSHGEGIVTIWKNSKNRLMDQLSRIKVNKEASIDAIIPTMNCDDGEMVDSVWCGDSEGLLHRINYKKGKVVETRVHSSAAGKHGPADEVGILDIDYDYRLISAGMDSLKIWSNQEETLNSDSDDSDSDDSDSDIGSNDSEDSDSDDDDVAINNKIEDEVNDFSPDSDSETGNDDLDENLEDVADSDSNEDQIENVTDEEHQLSDTELPTKSLQIIRKKRFNVPEISNKTNINKKVVDINKLTKEQSTKKADEEPEETEEPDKKKQKLKAKQMSTKQIRNMQKHEHGIRRFDDL

SEQ ID NO: 18653 - protein, 592 aa, Arabidopsis thaliana
MRRCKNNTDKFSVITMRLLTLLLICTFFFFFSFAYSAESDNETDSVVTREINGTVVESNATSAKPREDSFADMIDRALEKEFPDNDQNEVPDPGSFNNSVADQQAVLETVARVKPKKNETKTKEEKSFFNLDNENGVEDTPRLIDRKDNVFIMSNPKSKYPVLQLDLRLISDLVVVIVSATCGGIAFACAGQPVITGYLLAGSIIGPGGLSFVSEMVQVETVAQFGVIFLLFALGLEFSAAKLRVVRAVAIPGGLLQIFLFMCLSGITASLCGGKLTEGIFVGAFLSMSSTAVVLKFLMERNSISALHGQITVGTLILQDCAVGLLFALLPVLGGTSGVLQGVLSMAKSLAILIAFLGALFVLSRTWVPWFLKLMTSLSSQTNELYQLAAVAFCLLVAWCSDKLGLSLELGSFAAGVMISTTDLAQHTLEQVEPIRNFFAALFLASIGMLIHMHFLWNHVDILLAAVLLVIVIKTVVVAIVVKVFGYNNKTAVLVGMSLAQIGEFAFVLLSRASNLHLIESKLYLLLLGTTALSLVTTPLLFKLIPAVVHLGVLLRWFSPDSSTEIGFKGELYHSESAKRISLMIQGSLHDS

SEQ ID NO: 18654 - protein, 140 aa, Mesorhizobium sp. BNC1
MAIERTFSMIKPDATKRNLTGAITKMLEDAGLKVVASKRVWMSRRQAEGFYAVHKDRPFFDELCEFMSSGPTVIQVLEGENAIAKNREVMGATNPANAAEGTIRKVFALSIGENSVHGSDAPETAEQEIRYWFSETEIVG

SEQ ID NO: 18655 - protein, 335 aa, Aspergillus nidulans FGSC A4
MPRAEAGSTKALSNKLKAKGLGRLRWYCQACERQMRDENGFKCHVQSESHVRQVLLIGEDPKRYIEDFSRQFIKNFLDLLRTTHGEKKVHINQFYQQVIADKEHIHMNATKWKSLTQFAAHLGREGLCHVEETEKGLFVSYIDRSPEAMRRREAIMKKERQDRGDEEREQRLIQEQVERARAKEKEEEIGPEARNLQRKEGEKVKLNIGFGAKATPPASTEQSRTQSPDEKEKDKDKESSSATPESSATASPAPSQNPQAAPKVSMSLGGGNSKPKNVFASAAKKNPLAGKKATVVAPPKKMSEQERIMKQEMEAMERKRLGGGGMPNSKRPKVS

SEQ ID NO: 18656 - protein, 425 aa, Arabidopsis thaliana
  misc_feature (121)..(121): Xaa can be any naturally occurring amino acid
  misc_feature (163)..(163): Xaa can be any naturally occurring amino acid
  misc_feature (171)..(171): Xaa can be any naturally occurring amino acid
  misc_feature (176)..(176): Xaa can be any naturally occurring amino acid
  unsure (1)..(425): unsure at all Xaa locations
MAFSSLLRSAASYTVAAPRPDFFSSPASDHSKVLSSLGFSRNLKPSRFSSGISSSLQNGNARSVQPIKATATEVPSAVRRSSSSGKDKGWDSTAIWSGCVRLCAFYVNITAMMVWIFAVQXVLLCSMFCNIWVESRAFYSIFRSDSQCHQPMILGPKDVKSRXVTSMDKGXASWMXLGAGYVVKSSGVFTTLSKAASHLKGGAKKVIISAPSADAPMFVVGVNEHTYQPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTSNVSVVDLTCRLEKGASYEDVKAAIKHASEGPLKGILGYTDEDVVSNDFVGDSRSSIFDANAGIGLSKSFVKLVSWYDNEWGYSNRVLDLIEHMALVAASH

SEQ ID NO: 18657 - protein, 332 aa, Coccidioides immitis RS
MPPFPSPATGQQRESYTQMGPEHDLESIGKHCQFEYCHQLDFLPFRCESCKKTYCLDHRTETAHKCPNAGEWAAARRRKEASATSNNNNNNRMLSPSTLLPNSKPTIYNSAQCSHPKCKTLIHTLQNPGVHCQNCNRHYCLSHRLREDHDCTKLIPLGARPVGGKSVAQTNVDKARSAFSKLRAWGKDKSSSVTANLAPKPKPPSSAATRIANLNALKRSAKGDSNLDVSKRFYLHVEASADTTKSKFPSGDFYFDSSWSVGRVLDDAAKRLQVQNVNNRVEGEDERLRVFHVEGGRLLDFSEKIGNCKVAQGDTIVLLRGVGPPIPDLIEA

SEQ ID NO: 18658 - protein, 602 aa, Arabidopsis thaliana
MDPGDPTSILFTKIRTLEPDFASKIIGYLLLQDLGKTDLMRLALGPETLLQSVCLKAKSALGLSSNGSSSASSPLNPISRPINIHRHSLSHSSPGNGFSRNPLSPSFATPGSLGSNPNMISSPFQASSSLFASDGAAAGDSTGNGDFLDEQQLGNYLSFLNESSSKNNDESLDPFGFSADNGDAHLHKRSFSASDACFGSEEPGFGGGGYNRFLHGGLGDDFDSPGGFGSPDYVSRQQEEIVRMKMAQRQRMAAAQYLAATGSPMSYEKGLNFLLHQRNAHRSGAGQFGEEGYWFGSPGRHERDEFMGMGDKSNSASKQIYLTFPADSSFTDEDVSNYFGNFGPVQDVRIPYQQKRMFGFVTFLHSETVRIILARGNPHFICDSRVLVKPYKEKGRILEKRQQQQLLQQMERGNFSPGSSPSGMDSRDLFDSHLAPRMFSNTQEMMRRKAEQADLQQAIEFQRRRFLSLQLPDMDSESFLHHQRSLSIGSPVHFSPRVNQSMLFRSESTSDEVFEGNGDSGHQSEATRAFLSDTGHNISQERGYNSHLNKGQETSLENTLPDSFFASPSKTGETQHPEFEKENCATISVTTENKAASSLQSA

SEQ ID NO: 18659 - protein, 249 aa, Zea mays
  misc_feature (136)..(136): Xaa can be any naturally occurring amino acid
  misc_feature (146)..(146): Xaa can be any naturally occurring amino acid
  misc_feature (162)..(162): Xaa can be any naturally occurring amino acid
  misc_feature (166)..(166): Xaa can be any naturally occurring amino acid
  misc_feature (183)..(183): Xaa can be any naturally occurring amino acid
  misc_feature (241)..(241): Xaa can be any naturally occurring amino acid
  unsure (1)..(249): unsure at all Xaa locations
MTPSLQDAKITFLGGGNMAAAIIGGLLAKNTNKQNIYVSEPWDVNRNKMADLGVRTTADNKEAAADADVVILAVKPQVAKGVCEELSSAWAGRDSLPVVISIAAGITLASIAQWFKGDSGKAPHIVRVMPNTPALXGEGASGLYGXRMSLAAEKELTSALLXSVSXATEWVDKEELLDVVTGXSGSGPAYFFAFVEHLISSGVSLGLSEEQATRLAAQTCLGAGKMLVESSDEPFSLRKNXTSPNGTTH

SEQ ID NO: 18660 - protein, 317 aa, Mycobacterium tuberculosis CDC1551
MGSAGVPAADAGGRDAASEQIARWTQTCTVVLVCGHGPAKWAFRSWCTSRSCDTLPVALRYRLQSNPLVGKLTTKYFLPLGTRQVGDHVVFFNFGYEEDPPMALPLSESDEPNRYCIQLYHQTASQVDLTGKEVLEVSCGAGGGASYIARNLGPASYTGLDLNPASIDLCRAKHRLPGLQFVQGDAQNLPFPDESFDAVVNVEASHQYPDFRGFLAEVARVLRPGGHFLYTDSRRNPVVAEWEAALADAPLRTISQRDIGAQAKRGLDANTARSQEAIGRRAPVLLAGLTRCAVRVLDWDLRRGGGFSYRIYLFAKD

SEQ ID NO: 18661 - protein, 238 aa, Oryza sativa
MVAEAFTVDLNEPLVFQVGHLGEQYQEWVHQPIVSKEGPRLFANDVLEFLTRTEWWAIPLIWLPVVCWCLTKSVEMGHTLSEVALMVVFGICLWTLIEYIMHRFLFHINTKSYWTNTAHYLLHGIHHKHPTDGLRLVFPPAAAAILCFPFWNLIRLITTPTTTHGVFGGGLLGYVMYDCTHYYLHHGQPSSDPGKHLKKYHLNHHFRIQNKGFGITSTLWDHVFGTLPSTKTIDKKSS

SEQ ID NO: 18662 - protein, 510 aa, Vibrio fischeri ES114
MSAKKPMALVILDGYGHRETQADNAITNANTPVLDGLMANQPNTLISASGMDVGLPDGQMGNSEVGHTNIGAGRVVYQDLTRITKAISDGEFQQNETLVNAIDKAVKAGKAVHIMGLMSPGGVHSHEDHIYAAVEMAAARGAEKIYLHCFLDGRDTPPRSAENSLKNFQELFAKLGKGRIASLVGRYYAMDRDNNWERVQKAYDLMTEAKAEFTFATAVEGLEAAYAREENDEFVQATEIKAEGEESAAIVDGDAVIFMNYRADRARQITRTFVPSFDGFTRNVFPAIDFVMLTQYAADIPLLCAFAPASLENTYGEWLSKEGKTQLRISETEKYAHVTFFFNGGIEDEFEGEERQLVASPKVATYDLQPEMSAPELTEKLVAAIKSGKYDAIVCNFPNCDMVGHTGVYDAAVKAVESLDECIGKVVEAIKEVDGQLLITADHGNAEMMIDPETGGVHTAHTNLPVPLIYVGSKAVEFKEGGKLSDLAPTMLALTDTAIPAEMSGEVLFK

SEQ ID NO: 18663 - protein, 148 aa, Oryza sativa (japonica cultivar-group)
MVGVATSAHLHTTTTGRLSCACAPPTRGTRRRRLAVAVRVRVRVRASASEAMATEKLGVRVERNPPESRLSELGVREWPKWGCEKSKFPWTYSAKETCYLLQGKVKVFPDGAGEDFVEIAAGDLVVFPKGMSCTWDVAEAVDKHYKFE

SEQ ID NO: 18664 - protein, 272 aa, Shewanella oneidensis MR-1
MSQQKICFIGAGNMTRSIISGLIRSGYPASQVQATNPSQGKLDALATDFGVRVSQDNVSAAQDADVIILSVKPQLMEQVCQALQGIDMSNKLLITIAAGIKASRYSEYLAQPITLIRTMPNTPMQIGVGMTGLYAPQSLSDAQKAIAERLMSSGGEIVWVNEESDINQVIALAGSSPAYFFLLMESMIDAGKQMGMDEAKARSLVQQAALGAAMMAKQNPELTLGNLRENVTSKGGTTAQAIATFEAADLRGVVKKAMENCINRAEEMAKTF

SEQ ID NO: 18665 - protein, 259 aa, Candidatus Pelagibacter ubique HTCC1002
MSLKFIILGSGSSMGVPRADGYSGDCDLKNKKNFRTRCSALIKFNDQNILIDTSPDLRSQLLKNKIKSISKVFYTHLHADQTHGINDLRPFFLINKKQIPVYADSNTKKYLLSTFKYCFKSSFGYPSTLNIYSLKKKHEFIIKDKKIKIESIPVQHGKIKSICYLINNKLAYASDISLFFKKDYKKLKNLEYLIIDCLWCRNHSAHFNLDQVLEIVKILTPKKTILTNMHSDLDYAKLKKKLPKNIIPGFDGLTVSLKN

SEQ ID NO: 18666 - protein, 471 aa, Robiginitalea biformata HTCC2501
MATLGPATSDKEVLRRMIEAGVDVFRINFSHANYEDVGNRIRMIRELSEELGLYTAILADLQGPKLRVGVMSGEVVVAPGDEILFKTGKPFEGTAEEVYMNYENFPRDVKPGERILLDDGKLIFEILETNGKDSVKAKVIQGGPLKSKKGVNLPNTNISLPALTEKDIKDAEFAISQDVDWMALSFVRHSQDLMDLQELINKHSEHKIPIIAKIEKPEAVDNIDKIVAYCDGLMVARGDLGVEVPAQEVPLIQKRLVLRAKKARIPVIIATQMMETMITSLTPTRAEVNDVANSVMDGADAVMLSGETSVGNYPVQVIERMSSILKSVESSELIKVPHDPPHVRTKRYITKSVCYHAALMANEIKAKAISTLTNSGYTAFQISAWRPGAHILVFTSNKRILSQLNLLWGVKAFYYDRFVSTDETIEDVNKIACQKGYLEAGDMLISLAAMPIKDKGMVNTLRVTEIDSCNF

SEQ ID NO: 18667 - protein, 588 aa, Parvularcula bermudensis HTCC2503
MAAGGGTEFLVDAALYLGATAVAVPLFRKLKLGTILGYLGAGVLLGPSALNLLYNGDGVFAIAELGVVLFLFVIGLELSLSRLWSLRHTIFGLGLMQLLVTGTAIGWVIDYIDVLSTGPAYIVGFGLACSSTAFALSLLEERHELNTPHGTKAFSVLLLQDVAVIPLFAAIPFVATQGDNAADGLPIDWQAIGLAAGAIAAIVFLSHFVLDRVLRLVAISGSREAFTAAALLIVAVTALIVDAAGLSMALGAFLAGVLLAESTFRHQIESDIEPFRELLLGLFFIGVGMQLDLAVLRNAWVVVLFGAAALIVFKAAVIFVLARILKSATPTALKTAAVLSQGGEFGFVVFSLSVGEGLLTSADATMFSAIVTLSMMATPLIMMAVSKLEHNPSGAAIPVTDMEDHGSVLIVGFGRMGQLVNQVLRSSNVKTICIDNSPRRIEVASRFGNKVYFGNGTDVHLLFQAGALDVDAIVFTLNAKEKLKPVVQAVRERCPKVRILARVYDRLHEIEMMDVKADFVVREMYESSMALAGETLAGLGFSEQLIADIMAEYRERDRDRLLAQKAEGIYAKKDVLSKPFEAVEQELS

SEQ ID NO: 18668 - protein, 264 aa, Debaryomyces hansenii CBS767
MSIVSLLGIEVLNNPAKFTDPYEFEITFECLEPLKEDLEWKLTYVGSSRSLDHDQELDSILVGPVPVGINKFLFQADPPSPELIPASELVSVTVILLSCSYADREFVRVGYYVNNEYDSEELRENPPAKVQVEHVVRNILAEKPRVTRFNIVWDNEDGNADEYPPEQQVDEEEEEEEEEEEEEDDEEEEEEKDVEGEEGEEGEDAEEAAEVEENGSKEASKEEDIEEDIEEDIEEDIEEDIEIEDEEEAKNADQGETPIDKVQS

SEQ ID NO: 18669 - protein, 403 aa, Pseudomonas syringae pv. syringae B728a
MQFNKSNKLANVCYDIRGPVLKHAKRLEEEGHRILKLNIGNPAPFGFEAPDEILQDVIRNLPTAQGYSDSKGLFSARKAVMQYYQQKQVEGVGIEDIYLGNGVSELIVMSMQALLNNGDEVLVPAPDYPLWTAAVALSGGSPVHYLCDEQANWWPDLEDIKAKITPNTKAMVIINPNNPTGAVYSREVLLGMLELARQHNLVVFSDEIYDKILYDDAVHICTASLAPDLLCLTFNGLSKSYRVAGFRSGWIAISGPKHNAQSYIEGIDILANMRLCANVPSQHAIQTALGGYQSINDLILPPGRLLEQRNRTWELLNDIPGVSCVKPMGALYAFPRIDPKVCPILNDEKFVLDLLLSEKLLVVQGTAFNWPYPDHFRVVTLPRVDELEQAIGRIGNFLKGYRQ

SEQ ID NO: 18670 - protein, 1113 aa, Bordetella bronchiseptica RB50
MPATHPAPDPLWYKDAVIYQLHVKSFFDANDDGVGDFAGLLAKLDYIVELGVNTIWLLPFYPSPRRDDGYDIADYRGVHPDYGSLADARRLVRAAHARGLRVITELVINHTSDQHPWFQRARAARPGSAHRAYYVWSDDDKAYAGTRIIFCDTEKSNWTWDPVAGAYFWHRFYSHQPDLNYDNPQVLREVLGAMRYWLDMGVDGLRLDAVPYLVEREGTNNENLPETHAILRRIRRVIDSEYPGRMLLAEANQWPEDAQEYFGAGDECHMAFHFPLMPRMYMAIAQEDRLPVTDIIRQTPSIAPQCQWAIFLRNHDELTLEMVTSRERDYLWNVYAAEPRARINLGIRRRLAPLLERDRRRIELMNSLLLSMPGTPVLYYGDELGMGDNIHLGDRDGVRTPMQWSPDRNGGFSRADPERLPLPLLMGPLYGYEAVNVEAQQRDPHSLLNWTRRMLAKRRQSHVFGRGELSFLYPGNRKILAYLRTWEDTVVLCVANLSQAAQPVELHLSEYAGRVPVEMLGGTAFPQIGELPYLLTLPPFGFYWLDLSAGAAPPAWHSELPPQMPESITLVSRGAGAALRLTEASRRQLEADVLPAYLQRQRWYAARRKPGVMRLAYSVPLNDDVESYYEAEIEVSDDGPPRRFHTPVALAWQDDTAAQYPLARVRRGAQLGTLTDASLQPGYARVLLAALTAGRDIQAGGEPAVRLRFLPEPGLADLALRDDSEVRALSADQSNSSLLVGERVVFKLLRELHAGPHPEAEMTRYLTQAGYAHTPALLGEVVRVQGDQAPHTLALAHAYVVNEGDAWNWTVAYLKRTVDAAMLTGASADDYQQELAGYEVLAGTIGQRLAQMHSVLARAGELPGFAPRPASERDAALAGEHAVAQLDRALQALRACESGLAPASHACAQWLFEHRDRLAAHIMTLAQAETGALRIRVHGDFHLGQILVAQTDAYLIDFEGEPARPMAERRQLSSPFKDVAGILRSFDYAVAELSRDDPLGGAPRDFNTGVAEPADPASAPRETREALLARFRQRAGAALLASYGNAIDPVLALPPERAQALTCLYLLEKAAYEICYESAYRPERLPVPIHGLAETARAALLAAAVDHDEGPAP

SEQ ID NO: 18671 - protein, 443 aa, Pyrococcus sp.
MNEIKGIERAVQVEVPRPRFLLLAFTDINGSLKGMEIPMERYEEAVEDGVSFDGSSIPGFEGIEDSDLIFKADPSTYAEIPWEGIGRVYGYIYKGDEPYQADPRGILKRVLERLEKEGLKAHIGPEPEFYIFKKNGTWELHIPDSGGYFDLVGLDKAREIRREIALYMPYLGLKPEVLHHEVGKAQHEIDFRYDEALRTADNIVSFKHVVKAVAELHGYYATFMPKPIYGFPGNGMHLHISLWKDGENVFIGEDGLSDTALHFIGGILKHAKALAALTNPTVNSYKRLVPGYEAPVYISWGYRNRSALIRVPAFKGSGARIEYRCPDPSANPYLALAGILMVGLDGIKKKVEPDSYVETNVYEMDDAERERLGIDTLPGSLGEALEELKKDKTVREALGGANKNFIDYKEREWEEYIEYLSSRDIPIDTKKVTEWELERYFYV

SEQ ID NO: 18672 - protein, 465 aa, Debaryomyces hansenii CBS767
MSVPQQISETFQKAMNLSGSPNAVSTSPTQSYMSQYVSATQKPTKALKPFSTGDIKILLLENVNQTAISIFQNQGYQVEFYKSSLGEEELIEKIKEVHAIGIRSKTKLTEKILQHARNLVVIGCFCIGTNQVDLEYAAKSGISVFNSPFSNSRSVAELVIAEIITLARQLGDRSIEMHTGTWNKVSAKCWEIRGKTLGIIGYGHIGSQLSVLAEAMGMNVIYYDVQMIMALGNSKQVDTLDDLLQRADFVTLHVPETSDTKNLLSSPQFAAMKDGAYVINASRGTVVDIAALVQAMKSGKIAGAALDVYPQEPAKNGEGYFSNELNDWASELCSLRNVILSPHIGGSTEEAQSAIGVEVATSLTKYINEGNSTAAVNFPEVQLRALDLDQQNSVRVLYIHQNVPGVLKTVNNILSNHNIEKQFSDSRDDVAYLMADISDVDITDIKSLYEQLEQTPYKIATRLLY

SEQ ID NO: 18673 - protein, 517 aa, Zea mays
  misc_feature (237)..(237): Xaa can be any naturally occurring amino acid
  misc_feature (252)..(252): Xaa can be any naturally occurring amino acid
  misc_feature (281)..(281): Xaa can be any naturally occurring amino acid
  unsure (1)..(517): unsure at all Xaa locations
MANIDMAAVLADMERDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLAVLSCDPAAGTVRCRCENTAMLGERKNCNLPGIVVDLPTLTEKDKEDILEWGVPNDIDMIALSFVRKGSDLVTVRQLLGQHAXKRIKLMSKVENQEGXVNFDDILRETDAFMVARGDLGMEIPVEKXFLAQKMMIYKCNLAGKPVVTATQMLESMIKSPRPTRAEATDVANAVLDGTDCVMLSGESAAGAYPEVAVKIMARICVEAESSLDNDAVFKEMIKAAPLPVSPLESLASSAVRTANKARATLIVVLTRGGTTAKLVAKYRPRVPILSVVVPVLTTDSFDWTVSSEGPARHSLIYRGLIPLLAEGSAKHTDSESQSTEVILEAALKSAVQKQLCKPGDALVAFHRIGVASVIKICIVK

SEQ ID NO: 18674 - protein, 576 aa, Zinnia elegans
MAEPTCGSLLLQLQKIWDEVGESDEERDKTLLQIEQECLNVYKRKVDQAEKSKEHLLQTLEDAKLELSTLVGSLGEKSSIDIPEKTSGTINEQLASIAPALEQLWKKKEERIKEFSDVQSQIKRICGEIAGSNELAANVTVDVSDLTLKKLEEFHNHLQELQKEKSQRLNKVLEYVSNLHDICGLLGIDFYSTVSDVHPSLVDATCAQSKSISNDTLARLAKTVTALEEAKKQRLHKLQDLATQLSELWNLMDTSEEEMTSCDHVTRNISASVDEVTDPGALALTLIEQAEVEVERLDQLEATRMKEIALKKQDELEEIFAHAHIQNDSKAAREKVLALIDSGNIEPAELLADMDAQVIKAKEEALSRKDILDKVEKWMSACEEESWLEDYNRDTNRYNGSRGAHLNLKRAEKARVLVSKIPGIVDTLVAKTQTWEEEHGMTFAYDGVPLLAMLDEYSVLRNDREEEKRKIRDQKKFHEQLNTEQEAMFGPKPSPARPLSSSKKMMGQNGVPNKRLSLNQNGAPNRRLSLNQNGTPSRRLSLNQNGAKSGKRDNMRPVAPLNYVAISKEDAAPLTP

SEQ ID NO: 18675 - protein, 413 aa, Xylella fastidiosa 9a5c
MPPTKTSFPKQDIRILLLEGVSHSGIETFRAAGYSQIKIHTTSLPEEALQAEIAEAHIIGIRSRTQLNAEVLGHAKRLMAIGCFCIGTNQVDLDTAELSGIPVFNAPYSNTRSVAELIIAEAILLLRGIPQKNAECHRGGWSKSAINSHEARGKVLGIVGYGHIGTQVSVLAEAMGMQVIFYDIESKLSLGNARPAASLDELLGIADVVTLHVPETAATKNMLGHAELARMKPGAHLINASRGTVVEIDALDAALVSGHLGGAAVDVFPSEPKGNSDPFISPLSRHDNVILTPHIGGSTLEAQDNIGIEVAAKLIRYSDNGSTLSAVNFPEVSLPEHVGSMRLLHIHRNVPGVLSHINELFSRHNVNIDGQFLRTDATLGYVVIDIGASQTQALALKEALTQVPGTLRTRLLY

SEQ ID NO: 18676 - protein, 362 aa, Bacillus clausii KSM-K16
MNDSIPKKMKAVVAYGPKDYRLEEVDVPVIEHDKEIIVKVEATGICAGDIKAFDGAPSFWGDDTQPAYIKAPMIPGHEFIGHVVAKGDGVGDFEIGDRIISEQIVPCWECRFCNRGQYWMCEKHDLYGFQNNVNGSMAEYMKFTKEAINYKVPADLPIEQAILIEPYACSMHAVQRARIELGDIVVLSGAGTLGLGMIGAVKKSGAKTLVVLDLKDERLALAQQFGADVVLNPAKDNVVEKVKDMTDGYGCDVYIEATGHPASVEQGLSMIRKLGRFVEFSVFKDPVTVDWSIISDRKELDVLGSHLGPYCYPLVIEGIANGDLPTEGVVTHELPLERFAEGFELMKNGSNSLKIILKPQQA

SEQ ID NO: 18677 - protein, 95 aa, Glycine max
  misc_feature (85)..(85): Xaa can be any naturally occurring amino acid
  unsure (1)..(95): unsure at all Xaa locations
MEMFSSMISFPAVATVNRAGAGMVAPFTGLKSMAGFRTRKTYYVITSIASVGVRVQCMHVWPLIGWKTFATFHYLPDLDDALFAXVVAFLVRKGW

SEQ ID NO: 18678 - protein, 227 aa, Caulobacter crescentus CB15
MSADDQKRISGEAAAELVENGMVVGLGTGSTAAWFVKALAARGLKDIRGVPTSDATAALARELGIPLAALDDVKTVDLTVDGADEIGPGLSLIKGGGAALLREKLVWEASTRCVVIADAAKRVPALGKFPLPIEVVRFGHVHTGYRLADIAAEFDLPPPRLRTAERGMVVTDGGNLIYDMASGKIEDPTALAAALKSVTGVVDHGLFLDLADEALVGTDEGVVRLQP

SEQ ID NO: 18679 - protein, 107 aa, Burkholderia thailandensis E264
MQILTATALAEWLRDPARPAPVVLDVREPWEIATAKIDGSVSIPMQQIPARSEELDDEAPIVCVCHHGMRSAQVAMFLESRGFTKLYNLQGGIDAWSRDVDPSVPRY

SEQ ID NO: 18680 - protein, 998 aa, Oryza sativa
MRLHYHHLAVVLLAAVAAAATAAAGGEADALLAVKAALDDPTGALASWTTNTTSSPCAWSGVACNARGAVVGLDVSGRNLTGGLPGAALSGLQHLARLDLAANALSGPIPAALSRLAPFLTHLNLSNNGLNGTFPPQLSRLRALRVLDLYNNNLTGALPLEVVSMAQLRHLHLGGNFFSGGIPPEYGRWGRLQYLAVSGNELSGKIPPELGNLTSLRELYIGYFNSYSGGIPPELGNMTDLVRLDAANCGLSGEIPPELGNLANLDTLFLQVNGLAGGIPRELGKLASLSSLDLSNNALAGEIPATFADLKNLTLLNLFRNKLRGDIPEFVGDLPSLEVLQLWENNFTGGIPRRLGRNGRFQLLDLSSNRLTGTLPPDLCAGGKLETLIALGNSLFGAIPASLGKCTSLTRVRLGDNYLNGSIPEGLFELPNLTQVELQDNLISGGFPAVSGTGAPNLGQISLSNNQLTGALPAFIGSFSGVQKLLLDQNAFTGEIPPEIGRLQQLSKADLSGNSFDGGVPPEIGKCRLLTYLDLSRNNLSGEIPPAISGMRILNYLNLSRNQLDGEIPATIAAMQSLTAVDFSYNNLSGLVPATGQFSYFNATSFVGNPGLCGPYLGPCHPGLLALSIAFAAMAILKARSLKKASEARAWKLTAFQRLEFTCDDVLDSLKEENIIGKGGAGTVYKGTMPDGEHVAVKRLPAMSRGSSHDHGFSAEIQTLGRIRHRYIVRLLGFCSNNETNLLVYEYMPNGSLGELLHGKKGGHLHWDTRYKVAVEAAKGLCYLHHDCSPPILHRDVKSNNILIDSDFEAHVADFGLAKFLQDSGTSECMSAIAGSYGYIAPEYAYTLKVDEKSDVYSFGVVLLELITGKKPVGEFGDGVDIVQWVKTMTDSNKEHVIKILDPRLSTVPVHEVMHVFYVALLCVEEQSVQRPTMREVVQILSELPKPTSKQGEEPPSGEGAVFDLVVPAESAEANEAKEQQQQQLNSPSSPPPDLISI

SEQ ID NO: 18681 - protein, 291 aa, Boletus edulis
LENPEINITAVNDPFIDLDYMVYMFKYDSVHGRFEGEVSTKDGKLVINGKAITVFAERDPANIPWGTVGAQYVVESTGVFTTIEKASAHLKGGAKKVIISAPSSDAPMFVCGVNLDAYDPKHTVISNASCTTNCLAPLAKVVNDKFGIVEGLMTTVHATTATQKTVDGPSPKDWRGGRAVNNNIIPSSTGAAKAVGKVIPVLNGKLTGLAFRVPTLDVSVVDLVVRLAKPTSYEEIKTAFKEASESSELKGIVAYTEDAVVSTDFLGHHASSIFDATGGIMLNDSFVKLIA

SEQ ID NO: 18682 - protein, 488 aa, Prunus dulcis
LPTEDDMGNSEVGHNALGAGRIFAQGAKLVDSALETGKLYEGEGFKYIKESFPTNTLHLIGLLSDGGVHSRLDQLLLLVKGASERGAKRIRVHILTDGRDVLDGSSVGFAETLENYLAQLREKGVDAQIASGGGRMYVTMDRYENDWGVVKRGWDAQVLGEAPHKFKNAVEAIKTLRQEPNTSDQYLPPFVIVDENGKPVGPIVDGDAVVTFNFRADRMVMIAKALEYADFDKFDRVRFPKIRYAGMLQYDGELKLPSKYLVEPPEIDRTSGEYLTYNGVRTFACSETVKFGHVTFFWNGNRSGYFNPQMEEYVEIPSDSGITFNVQPKMKAVEIAEKGRGAILSKKFEQVRVNLPNSDMVGHTSSIEATVVACKAADEAVKIIIDAIEQVGGIYVVTADHGNAEDMVKRNKKGQPLLDKNGNIQILTSHTLQPVPIAIGGPGLAPGVQFRKDVPNGGLANVAATVMNLHGFEAPADYETTLIEVVDN

SEQ ID NO: 18683 - protein, 396 aa, Idiomarina baltica OS145
MDYQLSKRVNSIQPSPTLAVTQKANELRSAGKDVIGLGVGEPDFDTPDFVKQAAIKAIEDGKTKYTAVDGIVELKQAVSDKFKRDNQLEYGLDEIIVSAGGKHSIFNLLSAWLNPGDEVVIPAPYWVSYPDMVKLVEAEPVIVHTDLEQRFKITPEQLRDSLTEKTRLMFINSPSNPSGTAYSAEELRALADVLVDFPNVLIATDDMYEHILWDRSQFANIVMVAPELRDRTVILSGVSKAYAMTGWRIGYAAGPAPIIAAMKKIQSQSTSNPASISQHAAVAALNGDQSCIDTMVSAFKERHDYLVSALNEIEGIECVKGDGTFYTFARIQNLIEKAGVANDVELCEKLLTEANVALVPGSAFGTEGYCRLSFATSLDTLKEAVARINQFVKALK

SEQ ID NO: 18684 - protein, 221 aa, Arabidopsis thaliana
MRLSFSSGSSGSSASREILVQHLLVKNNDVELFAELQKKFLDGEEMSDLAAEYSICPSKKDGGILGWVKLGQMVPEFEEAAFKAELNQVVRCRTQFGLHLLQVLSEREPVKDIQVEELHSKMQDPVFMDEAQLIDVREPNEIEIASLPGFKVFPLRQFGTWAPDITSKLNPEKDTFVLCKVGGRSMQVANWLQSQGFKSVYNITGGIQAYSLKVDPSIPTY

SEQ ID NO: 18685 - protein, 445 aa, Oceanospirillum sp. MED92
MSSNNDKEFDLFITDLNGNLRGKRMPANALSKVMEEGVKLPRSVIGFDFWGDDVLDNGLVFETGDSDGICMPVHDEAVPVPWADSPRNQILATMFNPDGTPFSADPRQALNAVVDRFKKLGLTPVVATELEFYLMDGKSEETQRPQPPILVEGHGRRLAETDCYSIDEMDGLSSFFAEVREVCEQQGVPADTIISELGPGQFEINLNHVPNPMLAGDQAIMFKRLVRGIARKHGYSATFMAKPYANKSGNGFHVHFSLLNEAGINVFDNGGDEGTDVLKHAVAGLMNTMADSMLAFAPHMNSYRRFMVGAHAPTCASWGYENRTVAIRIPDSPPVARRIEHRVAGADANPYLVLATILAGALYGIENKLMPPAPIAGDAYTEANQDLILPNKWDDATDIFNRSDVMREYLGEEFVRVFTAAKRQELRKLHAQISDIEYESYLGFL

SEQ ID NO: 18686 - protein, 256 aa, Vibrio fischeri ES114
MRHPVVMGNWKLNGSKEMVVELLNGLNAELEGVTGVDVAVAPPALFVDLAERTLTEAGSAIILGAQNTDLNNSGAFTGDMSPAMLKEFGATHIIIGHSERREYHNESDEFVAKKFAFLKENGLTPVLCIGESEAQNEAGETVAVCARQIDAVINTQGVDALNGAIIAYEPIWAIGTGKAATAEDAQRIHAQIRAHIAEKSEEVAKNVVIQYGGSVKPENAAAYFAQPDIDGALVGGAALDAKSFAAIAKAAAEAKA

SEQ ID NO: 18687 - protein, 471 aa, Klebsiella pneumoniae
MLLPVIMAGGTGSRLWPMSRELYPKQFLRLFGQNSMLQETITRLSGLEIHEPMVICNEEHRFLVAEQLRQLNKLSNNIILEPVGRNTAPAIALAALQATRHGDDPLMLVLAADHIINNQPVFHDAIRVAEQYADEGHLVTFGIVPNAPETGYGYIQRGVALTDSAHTPYQVARFVEKPDRERAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDEQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLTENQSTFIPIGAEHSLENPGRIPLEVLEIQSGSYLGEDDIIRIKDQYGRC

SEQ ID NO: 18688 - protein, 397 aa, Streptococcus pyogenes MGAS315
MPKLSKRVLEMKESVTLAAGARAKALKAQGRDVLNLTLGEPDFFTPKHIQDKAIESIQNGTASFYTNASGLPELKAAIATYLKNQYGYHLSPDQIVAGTGAKFILYAFFMAVLNPGDQVLIPTPYWVSYSDQVKMAEGQPIFVQGLEENQFKVTVDQLERARTSKTKVVLINSPSNPTGMIYGAEELRAIGEWAVHNDILILADDIYGSLVYNGNQFVPISTLSEAIRRQTITVNGVAKSYAMTGWRVGFAAGEPEIISAMSKIIGQTTSNLTTVSQYAAIEAFCGSQSSLEEMRLAFEERLNITYPLLCQVPGFEVVKPQGAFYFFPNVKKAMEMTGFSDVTSFANAILEEVGLAVVSGAGFGAPENVRLSYATDIKTLKEAVRRLHVFMESNEIN

SEQ ID NO: 18689 - protein, 256 aa, Legionella pneumophila subsp. pneumophila str. Philadelphia 1
MRHSPRKRFGQNFLQDKYIINEILRAINPLADDNMLEIGPGLGALTQPLLQKLNQLTAIEIDTDLQSYLTCLPASQGKLNLIPADALTVDFCQFGPHLRVVGNLPYNISTPLLIYLLKFITCIDDMHFMLQKEVVERIAAAHGTKAYGRLSVMLQYHCEVEYLFDVPPEAFEPRPKVDSAIVRLTPYRVSPFESVNTEKLENIVAKAFAMRRKTLTNNLKGIISLSQLNDLGIDGGKRPEQISVAEYVQLAKFISN

SEQ ID NO: 18690 - protein, 127 aa, Oryza sativa
  misc_feature (9)..(9): Xaa can be any naturally occurring amino acid
  unsure (1)..(127): unsure at all Xaa locations
YSVNEGHAXTGNGPTTKYVKKCRFPKDGSFAKSLRYVGSMVADVHRTLLYGGIFLYPADKKSPNGKLRVLYEVFPMSFLMEQAGGQAFTGKKRALDLVPEKIHERSPIFLGSYEDVEEIKALYAAEE

SEQ ID NO: 18691 - protein, 136 aa, Oryza sativa (japonica cultivar-group)
MSSWAGPDEIFLSTSLAGFLDKKLIVLLRDGRKLLGTLCSFDQFANVVLQGACERVIVGELYCDVPLGLYVIRGENVVLIGELVWFWIEQDREKDELPAHMTCVSEAEIRKAEKAEREARDLKGSMRKRMEFLDFD

SEQ ID NO: 18692 - protein, 189 aa, Triticum aestivum
HSITSLYKKAGWYRSGIPGISSTHASADPVGCYKEIYRVLKPGQCFAVYEWCITDHYDPNNATHKRIKDEIELGNGLPDIRSTRQCLQAVKDAGFEVIWDKDLAEDSPLPWYLPLDPSRFSLSSFRLTTVGRIITRNMVKVLEYVGLAPEGSQRVSSFLEKAAEGLVEGGKKEIFTPMYFFVVRKPLSE

SEQ ID NO: 18693 - protein, 583 aa, Kluyveromyces lactis
MTITKLLRDPQTEPKWWKEAIVYRFQDSNHDGWVRYQRYVSKLSTLKELGANAIWICPFYDSPQEDMGYDISDYEKVWPRYGTNEDIFNLIDRAHGLGIKSIVDLVINHCSSEHAWFKEARSSLDNPKRDWFIWKAPKGFDSNGKPIPPNTWRSFFGGSAWRYDEHTGQFYLRLFAKGQPDFNWENEVTRNAIYESAVGFWLDHGVDGFRIDTAGLYSKQPGFPDVPIINPGLDFQHPDPAILNGPRIHEFHKEMNKFMRERVKDGRELLTVGEIPCGTHDVCKAYTSAKDQEITQLFEFEHVSVGRKPGNVGVVNFKLSEFKDGIAARFQFIDKTDSWSTVYIENHDQPRSVTRFGDDSPEYREISAKLLALLETSLTGTLYVYQGQELGMINFRDWPIEKYEDVEVKGMYKWMVDQFGADSDQVKDYVNGLQLISRDHARTPFPWTSEAPYAGFTDGKEPWFPLTETFQEGINAEDELKDPKSVFNFWKTAIEVRKTHKDVLNYGYDFTFVDHANKKLFAFTKKFGEKVLYVVLNFSKEEIEFSFLEGYNSYDYIFGNYPEAEIDLDLTSLQPWEGRFYYA

SEQ ID NO: 18694 - protein, 268 aa, Borrelia garinii PBi
MKRALDLIKNNLEKTNIVLEILDARAPFSSKNPLTEKIIKNQTKIILLHKSDIAQIAEIIKWKKYFENLGNTVIISNIYKKGMRKQIIDNIKKLAIVKKIKNYKEKIKVLIIGVPNVGKSSIINLLSGKKSAKVANKPGYTKNIQIVKINEEINLFDMPGILWHNLADQSIAKKLAILDMIKNEIVDNIDLALYLLEIMDQNNKNILLKKYEIYHKNSLDILQNFAKARKLIHKKNELNLEKASKILIKEFREGKFGKIILDKNYNVF

SEQ ID NO: 18695 - protein, 324 aa, Glycine max
MMMMTMEGMMDKGVLDDVIRRLLEGKGGKQVQLSESEIRQLCVNARQIFLSQPILLDLRAPIRVCGDIHGQYQDLLRLFEYGGYPPAANYLFLGDYVDRGKQSLETICLLLAYKIRYPDKIYLLRGNHEEAKINRIYGFYDECKRRFNVRLWKIFTDCFNCLPVAALIDEKILCMHGGLSPELQNLDQIREIQRPTEIPDNGLLCDLLWSDPDASIEGWAESDRGVSCTFGADVVAEFLDKNDLDLVCRGHQVVEDGYEFFAKRRLVTIFSAPNYGGEFDNAGALLSVDDSLVCSFEILKPADRASGSGSSKMNFKKPPKLGKI

SEQ ID NO: 18696 - protein, 279 aa, Bacillus cereus ATCC 10987
MKNLQSTTTLHNGVEMPWFGLGVFKVEDGPELVEAVKSAIKAGYRSIDTAAIYGNEKAVGEGIRAGIKEAGISREDLFITSKVWNSDQGYETTLAAYEESLKKLELDYLDLYLVHWPVEGKYKDTWRALETLYKEERVRAIGVSNFQIHHLQDVMKDAEIKPMINQVEYHPRLTQKELQAFCKEQGIQMEAWSPLMQGQLLDNETLQAIAEKHGKTTAQVILRWDLQNGVITIPKSTKEYRIIANADVFNFELTKEDMEKIDALNQNHRVGPDPDNFDF

SEQ ID NO: 18697 - protein, 251 aa, Schizosaccharomyces pombe
MKPDTVSLTRAFSKATSTSSKAALSWLKKYNFDYDVAYTKWIQQKSREEAEKQLNNVFSQFSSKEDKDLIELDGSVQLFTALDISLEDPETLLVSYFLKSPRMGEFHRESFVEGALNLSTTSLDQLKLAIKEKVQVWRSDASLQKAIYIYTYPLACDKGKKTLSTSIAIEFFQILLKDTFPLLDDWIAFLKVSPIIEKSLPKDTWNELWDFSVFVKSDPNCSNYDFEGAWPTLIDEFVSYYREHGYKNSSS

SEQ ID NO: 18698 - protein, 538 aa, Oryza sativa (japonica cultivar-group)
MAAIGNMNLFDLFFVLQLLLSGVCVLVICYRYQRLKSMKKCSLGVVQWPIVGVLPAIVANMHRLLDGVTFLLATSQLNFQCRFWLAGFRFFVTCDPDNVRHIFTSNFDNYPKGDVFADMFDVLGGGIFNTDGERWRRQRNKAQMLMTTPRFRAFVARSSLDKVEKGLLPFLAHVADARKTCDLQDVFTRWSLDATCHLVFGVDPGCLDIGLPEVPFARAMDDVLRTIFLRHTMPVSFWKTMRWLGIGHEKRNAAARRTVESFVASAIAKHRADDESKSRQGGGGGGDKQSVADLLSSFLCDDEIAGSADADVYIRDMAMNLLVAGRDTTSSALSWFFYLLSTNPRVEQKLLQELAPIASRKPQLQQGRLFPGNGGMVTFDASEVRNLLYLHAALCEAMRLYPPVPLEHKAAVADDVLPSGHEVMAGDKVLVFYYSMGRMKRVWGKDCREFRPERWITEDGKLRYVPSNKFVAFNSGPRTCLGKEMALVQMKVTAAAMAWNFAVEVVPGHVVEPRLSVILHMKNGLLVRVKRREPVMNT

SEQ ID NO: 18699 - protein, 290 aa, Lactarius deterrimus
LLDPRVKVLAVSDPFIDLQYMVYMFKYDSVHGRFKGTVEIKDGKLVIDGHPITVFQERDPANIQWGSVGADYVVESSGVFTTVDKASAHLKGGAKKVIISAPSADAPMFVVGVNLDAYDSKYTVISNASCTTNCLAPLAKVINDKFGIVEGLMSTIHATTATQKTVDGPSNKDWRGGRAVNGNIIPSSTGAAKAVGKVIPALNGKLTGLAFRVPTNDVSVVDLVVRLEKEATYDEIKLAVKEAADGPLKGIIEYTDDLVVSTDFIGSTASSIFDAGAGIQLNKNFAKLIS

SEQ ID NO: 18700 - protein, 391 aa, Prosthecochloris aestuarii DSM 271
MGLWRLNPVKEAVRFFSRISGGCRSNAIVLAGINLSQGVCDTPVPGVVLEGASHALSQRQNSYTHYAGIGGLREALAEKYRTMYGIDVDPQQEIVVSAGATGAMYCAFQALLNPGDEVIVFEPYYGYHISTLNALQAVPVFLSLTSPDWTFSEADLEAAVSSRTRAILINTPGNPSGKVFTLAELQRIADFAEEHDLFVFTDEIYEHFLYDGRRHHSPFALPGMRKRTVLISGFSKTFSVTGWRIGYAISDARWAQAIGYFNDLVYVCAPSALQPGVAAGLATLDTSYYLSLSAEYGFKRNRFCRALGEAGLNAVLPQGAYYVLADVSHLPGSTTRDKAMHILRTTGVASVPGSAFFRNENDQHLVRFCYAKDDVVLDAACERLMKLKEMD

SEQ ID NO: 18701 - protein, 94 aa, Zea mays
  misc_feature (82)..(82): Xaa can be any naturally occurring amino acid
  unsure (1)..(94): unsure at all Xaa locations
VAGTDKETTTRGHDDLGKRCAKYYEAGARFAKRRAVLKIGPNEPTQIAIDLNAQGLARFTIICQENRLVPIVEPEILVYGPXDFDRCAYVTGTG

SEQ ID NO: 18702 - protein, 372 aa, Idiomarina baltica OS145
METIKSRAAVAWGPGEPLKMEEIDVAPPKKGEVRVKIIATGVCHTDAYTLSGADPEGIFPAVLGHEGGGIVESVGEGVTSVEVGDHVIPLYTAECGECKFCTSGKTNLCQAVRATQGKGLMPDGTTRFSKNGEPIYHYMGTSTFSEYTVLPEISVAKIPKEAPLEKVCLLGCGVTTGMGAVKNTADVQEGDTVAVFGLGGIGLAVIIGAVQAKASRIIAIDVNEDKFEIAKQLGATDFVNPTDYDKPIQEVIVDMTDGGVDFSFECIGNVEVMRSALECCHKGWGESVIIGVAGAGEEISTRPFQLVTGRVWRGSAFGGVKGRSQLPDYVQQYMDGKFDLDTFITHNMSLEEINEAFELMHEGKSIRSVIHY

SEQ ID NO: 18703 - protein, 269 aa, Zea mays
MCNGKGIQTCLQCSGECVIWQESVDEQPWEKVRSSSPLKVKEDDEVDKLEININNPKRSKRTYASTSPEVAKKISRSLRSLNAQTGLFTKHMKIIHQDPELRAQRVAAIKRTKGSDVARKRASEIQKAFFSDPENRLKRSIAMKGVKFYCSKCGQEGHRSFYCPTLREGSTRVRFRCRLCGREGHNSRTCGKPKSEKEHKQRPHHCSRCGEKGHNRRNCPTSTDLGSDASGYVVNKVNGSNSAVYQCSICLEKGHNRRTCPKRKATLLK

SEQ ID NO: 18704 - protein, 231 aa, Prochlorococcus marinus subsp. pastoris str. CCMP1986
MKQIVADSAIEEVEDGMILGLGSGSTAALMIKSLAEKIRSGKLKNIKGVPTSFQSEVLALELNIPLIDLASVPYIDLAIDGADEVDPDFQLIKGGGACHVREKLVASKANKLLIVIDESKLVQNLNQVFPLPVEVMPSAWKQVKDIISEMSGVSNLRMATKKAGPVVTDQGNLILDVLFDAGIRDPKDLEMRINNIPGVLENGLFVDLADKVLVGKIEDDVPVLFSPSRRS

SEQ ID NO: 18705 - protein, 137 aa, Brassica napus
TYEEWNIDFSELTVGIRVGIGFFGEVFRGVWNGTDVAIKVFLEQDLTAENMEDFCNEISILSRLRHPNVILFPGACTKPPRLSLITEYIDMGSLYNLLHLSGPKNKSSWRRRLTMLRDSCPGLMCIHRMGIVHRDIK

SEQ ID NO: 18706 - protein, 180 aa, Vibrio fischeri ES114
MAGDWLHTSSIFLAAAVVTVPLAQRFGLGAVLGYLLAGIAIGPWGLKLISDVDAILHFSEFGVVLLLFLIGLELNPSKLWKMRKPIIGLGGSQVVVSSVVITAAMMFFGLAWQVSLVIGMGLALSSTAIALRVIEERKLSDSESGQSGFAVLLFQDIAVIPMLAILPVLAGGASGNWLDG

SEQ ID NO: 18707 - protein, 351 aa, Vibrio fischeri ES114
MLAESEFRHELEVAIEPFKGLLLGLFFIAVGMSVNLGLLLQYPFEILAAVLLLVVVKGLLIYGLARAFGTRAKARSQMAMILSQGGEFAFVLFTAAQMEGLLSRELTAFLLVVVSISMMTTPLFLIAQDKWFARTLNSEEEMPLSDFTHATQPEVIIAGFGRFGQIVGRLLFANKIKLTILEADPSQIRLLRKFDYKVYYGDATQVELLRAAGAEKAKAIVVCKKDPQKVMEVVALCQRHFPHLKILARARSRVEAYELLSEGVDNFSRETFYGALDLGRQTLTSLGMHPYQAKRAESHFKKLDVAMLKELLPLHSDDKSLASKAKAARIELEEIFSLEMENERSSQNHWD

SEQ ID NO: 18708 - protein, 360 aa, Aspergillus nidulans FGSC A4
MCIYKQPEDTAANNKRRRNRMGLPTFLYNQLLITPAIPTNPFTGQTAIITGSNTGLGLETARHIARLGADKVILAVRNTAAGENAAKDIEESTICKPGTCEVWPLDLASRHSVLAFAEKAKKELGRIDVLVLNAAVATKIFQLADGGYEHSITVNTINHFLLAIALLPKLQETGTNFTNRLAPPHLTVLTSQVHAWPEFPQSTDPRGIFVALSDKATAKMDERYPVTKLLNVYLTRELVEQLYSDSDGKDGEPSVVINMLDTGFCHSQLSRENQGVDALVFNLFKRLFARKEEVGARTTVTAASAGVESHGKYMVNGIVADEALSERIYNEEGRMIQKRLWKELTDIIKGFKPQIMEEFK

SEQ ID NO: 18709 - protein, 146 aa, Oryza sativa (japonica cultivar-group)
MAYMRVTHRDEEGKKVTEKVPIPETRRPDTARHFERKLEEQGFHRLERHPANGPARAGIGAPPPKSGRGGKFTWEGPDGPVDAQLQPAPPAVDPNDPNYDEGDGAGVDEEVAKEVVIGEVEVAKVAEARDGVDVVAPAPLLQQEQQ

SEQ ID NO: 18710 - protein, 1219 aa, Trichodesmium erythraeum IMS101
MVHIKCLELTNFKSFGGTTTIPLLPGFTVVSGPNGSGKSNILDALLFCLGLSTSKGMRAERLPDLVNNKLAGRKTVETIVTVTFDLEDLSSQKNGQNELGSVQPQVPEVEENGYKTRETKDPFEITNSFDSLLEWSISRRLRVTKQGTYTSTYYMNGQPCTLSQLHEQLNQLRVYAEGYNVVLQGDVTGIISMKSRERREIIDELAGVAQFDRKISLAKEKLDLVKEQEEKSRIVERELEKQCGRLSQDCVKAKKYQQLRGELEEKSLWQTILRWQNLQKQEWKLRENIESGDRSVTEFNQNIQAKETEVRQAQTELDDLNAQVKALGEEQLLALQSSLATQEAERCQFQKKHKELEATIQQTQKNLSQLEQEVNKHQQNLEVLATEIVVQTQNVSFLEAGRNEAQEILNQQRGSASAIADTAEAWVKEQGQLHHQIESLQQTLNPQRTEQARVRERAYQLEKQIQEQQESLGVLGEEIEGYGKHYEQVKESKETARYQVESLTKQLEAVEQDLKVQQDTQTRLLQEQRDRQRKLDKLEAQQQAIQEATGTYATKMLQQSGISGICGLVAQLGRVEPKYQLALEIAAGGRLGNMVVENDGVAALGIEFLKRHKAGRMTFLPLNKIRYPAQKRDGSLGWGAAGFIDYAVNLIECDPHYQDIFAYVFGSTLVFDILVNARKYLGKYRIVTLDGEILESSGAMTGGSMSRRSGSLHFGTVDGRDLTEIGEMESHSQRLQEIDIVLERCLVEIEGLKEKVKERSQAFMEGKQYFRETELKVSQIEAELQRLIRQQEQGQGQLEKNNQELVDAHNRLMSLDQEIPAQEVQLTELRKTLAELEKSHTHSEWQQLQTMIRSQEVVLQEQEATLRSAEQKLQHLENQQRLLQEKVEAISRRCSEYQEQELDAYNTIKEVKSQILVVDEEVGKTREGMAKVEERLGTEKQKRDEAEANLRELYLAKQGLEWQLQKLQESQQGRREQLVPLQILLEEQKAELPDPLPIVPEKIKMTELEKEVRSLQKQLQALEPVNMLALEEYEQTQKRLEELSQKLGTLEEERTALLLRIENFTTMRQRSFFEAFNAVNKNFQTIFAALSEGDGYLQLDNQEDPFNSGLNLVAHPKGKPVQRLASMSGGEKSLTALSFIFALQRYRPSPFYAFDEVDMFLDGANVERLAKMIKQQAEGAQFIVVSLRRPMMELSERTIGVTQARGAYTQVLGIKMSQH

SEQ ID NO: 18711 - protein, 626 aa, Saccharomyces cerevisiae
MNDDSQDKIIHDIRIQLRKAATELSRWKLYGSSKWAAEALAGLAEAIDVDQTHSLADESPLRNKQGVPKQMFEIPQNGFGLSETEYDLYLLGSTLFDAKEFDRCVFFLKDVTNPYLKFLKLYSKFLSWDKKSQESMENILTTGKFTDEMYRANKDGDGSGNEDINQSGHQRANLKMVSNEHESQSNISSILKEINTFLESYEIKIDDDEADLGLALLYYLRGVILKQEKNISKAMSSFLKSLSCYSFNWSCWLELMDCLQKVDDALLLNNYLYQNFQFKFSENLGSQRTIEFNIMIKFFKLKVFEELNGQLEDYFEDLEFLLQVFPNFTFLKAYNATISYNNLDYVTAESRFDDIVKQDPYRLNDLETYSNILYVMQKNSKLAYLAQFVSQIDRFRPETCCIIANYYSARQEHEKSIMYFRRALTLDKKTTNAWTLMGHEFVELSNSHAAIECYRRAVDICPRDFKAWFGLGQAYALLDMHLYSLYYFQKACTLKPWDRRIWQVLGECYSKTGNKVEAIKCYKRSIKASQTVDQNTSIYYRLAQLYEELEDLQECKKFMMKCVDVEELLEGIVTDETVKARLWLAIFEIKAGNYQLAYDYAMGVSSGTSQEIEEARMLARECRRHM

SEQ ID NO: 18712 - protein, 237 aa, Triticum aestivum
  misc_feature (37)..(37): Xaa can be any naturally occurring amino acid
  misc_feature (45)..(45): Xaa can be any naturally occurring amino acid
  misc_feature (76)..(76): Xaa can be any naturally occurring amino acid
  misc_feature (86)..(86): Xaa can be any naturally occurring amino acid
  misc_feature (119)..(119): Xaa can be any naturally occurring amino acid
  misc_feature (136)..(136): Xaa can be any naturally occurring amino acid
  misc_feature (187)..(187): Xaa can be any naturally occurring amino acid
  unsure (1)..(237): unsure at all Xaa locations
PPGYDLTSRFPLLEGWQRWANMRQLLRLGSRIPLAVXIDQNAQGXARMASSARGKLCSHCEPEILVDRLHDIIRCXFVAEIVLPPXFKNLTAQHVLLEDALVNIHMVSPGCDFKKVTPXEVIPEFTCRILQRGVPXAVSAIVFLCGGQSEEEATLNLISMNKLQTKKSWNLSLSFGRSLQQSTLKTXSDKTENEEKTMAAFLVRCKSNYESSLGTYKGDANLSEGTSEIIHVKEFKY

SEQ ID NO: 18713 - protein, 479 aa, Arabidopsis thaliana
MENITAQLKRGISRQFSTGSIRRTLSRQFTRQSSLDPRRTNMRFSFGRQSSLDPIRRSPDSSKSDDEPHMSVPENLDSTMQLLFMASKGDVRGIEELLDEGIDVNSIDLDGRTALHIAACEGHLGVVKALLSRRANIDARDRWGSTAAADAKYYGNLDVYNLLKARGAKVPKTRKTPMTVSNPREVPEYELNPLEVQVRKSDGISKASYQVAKWNGTRVSVKILDKDSYSDPERINAFRHELTLLEKVRHPNVIQFVGAVTQNIPMMIVVEYNPKGDLSVYLQKKGRLSPSKALRFALDIARGMNYLHECKPDPIIHCDLKPKNILLDRGGQLKISGFGMIRLSKISQDKAKVANHKAHIDLSNYYIAPEVYKDEIFDLRVDAHSFGVILYEITEGVPVFHPRPPEEVARMMCLEGKRPVFKTKSRSYPPDIKELIEKCWHPEAGIRPTFSEIIIRLDKIVANCSKQGWWKDTFKFPWK

SEQ ID NO: 18714 - protein, 475 aa, Burkholderia pseudomallei K96243
MNIHPVILCGGSGSRLWPMSRGGYPKQYLKLAGDRSLVQQTALRLRNIPDTTAPIVVTNNEQRFLVAEQLRQVDITPSSIVLEPVGRNTAPAIAIAALLAMHDSPEALLLVLPSDHVILNEPAFITAAREAAAIAADKHLVTFGITPTQAHTGFGYIRRGPLLADGGQAFKVDAFVEKPDASTAERFVRDSGYYWNSGMFMLKAATYMEELHRHAPEIARQAEFALASAKRDHDFLRLDADAFFACPNVSIDYAVMERTERAAVIATADLGWSDIGSWSALADIADTDAQGNALVGDVFTDSVKNSYIRAEHRMIAALGLDDIVIVETADAVLVAHRDKAQDVRKIVEWLNASGRHESVTHRRVVRPWGSYEGIDQGERFQVKRIVVNPGAQLSLQMHHHRAEHWIVVKGTALVTNDGKEIILTENQSTYIPLGATHRLTNPGKIPLELIEVQSGSYLGEDDIVRFEDTYGRTST

SEQ ID NO: 18715 - protein, 427 aa, Methanococcus maripaludis S2
MELNIKMDRSKELFEESKKYLVGGVNSPVRLFKPFPFFVKSAKDCFLYDEDGNEFIDYCLAYGPMVLGHANENILNAVKSQMDLGTAYGVPSEKEITLAKEVINRIPCAEMVRFVNSGTEATMGAIRLARGVTKRNKIIKFEGAFHGAHDYVLVKTGSGALTHGAPNSPGIPEDTTKNTLLIPFNDEEAVRKVISENKEEIACIILEPVMGNVGCIPPKDGYLQFLREITEENGILLIFDEVITGFRLSKGGAQEYYGIKSDLATVGKILGGGFPIGAITGKKEYMEQFSPNGQIYQAGTFNGNPISVTAGIETLKNLDDKFYKETTKKAGILSNCLRETAEKYNIPAKVYNVASIFQVYFNDKEIVTYEDAKSSDTEKFMKYFYTLLENGVFVAPSQFECCFTSIKHNDEVLEKTMNAIDIAMKKL

SEQ ID NO: 18716 - protein, 337 aa, Anabaena variabilis ATCC 29413
MIRVAINGFGRIGRNFARCWLGRENSNIELVAVNDTSDPRTNAHLLKYDSMLGKLKNVDITADDNSITVNGKTIKCVSDRNPENLPWKEWEIDLIIESTGVFTSKEGALKHVNAGAKKVLITAPGKNEDGTFVIGVNHHDYDHNVHHIISNASCTTNCLAPIAKVLNDKFGIIKGSMTTTHSYTGDQRLLDASHRDLRRARAAAINIVPTSTGAAKAVALVIPELKGKLNGVALRVPTPNVSMVDFVVQVEKRTITEEVNQALKDASEGPLKGILDYSELQLVSSDYQGTDASSIVDASLTLVMGNDLVKVMAWYDNEWGYSQRVLDLAELVAEKWV

SEQ ID NO: 18717 - protein, 251 aa, Desulfovibrio vulgaris subsp. vulgaris str. Hildenborough
MKKLIAANWKMYKTIDEARATGRELVSAVAGSLPADREVLVCPPFTALHALHDTFKDVEGFAIGGQDVYPATEGAYTGEIAPGMLLDAGCGWVLTGHSERRHILGEDDETVARKTAFSLKAGLRVVLCIGEKLDEREAGRLEDVLAHQLQVGLADVDATYVPQSLVVAYEPVWAIGTGKVAGPAEVVEAHALVRSLLEARYGRDGAAIRILYGGSVKPDNAAELLSLDNVDGLLVGGASLQAVSFSRIILA

SEQ ID NO: 18718 - protein, 375 aa, Trichophyton rubrum
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIIFETFNAPAFYVSIQAVLSLYASGRTTGIVLDSGDGVTHVVPIYEGFALPHAISRIDMAGRDLTDYLMNILAERGYSFSTTAEREIVRDIKEKLCYVALDFQEEIQTAAQSSSLEKSYELPDGQVITIGNERFRAPEALFQPSVLGLEPCGIHVTTYNAIMKCDVDVRKDLYGNIVMSGGTTMYPGISDRMQKEITALAPSSMKVKIIAPPERKYSVWIGGSILASLSTFQQMWISKQEYDESGPSIVHRKCF

SEQ ID NO: 18719 - protein, 552 aa, Leptospira interrogans serovar Copenhageni str. Fiocruz L1-130
MNPNMKLSKKYTFRSRKVLLIILDGVGYSPKGPESGNAIAGAKLPFLNRVWNQFPTLHIQAHGKAVGMPSDDDMGNSEVGHNVLGSGRIFDQGAKLVSNSIASGDIFNGQAWKEVIGNSKKNNSTLHLLGLFSDGNVHSHIDHTKALISQAILEKVPKIRLHILLDGRDVPEKSALDYLNPFETWLNSLRKSGTDIRIASGGGRMTITMDRYEADWSMVERGWKVHVKGEGRYFSSAKEAIETFRSENPKIIDQYLPSFVISDNGKPVGKIQDGDSVVFTNFRGDRAIEISLAFTEKNFDKFDRGPLPNVLYAGIMQYDGDLKLPERFLVAPPAIDRTLGEYMASSNIPQYALSETQKYGHVTYFWNGNKSGYFDQNSEEYREILSDVIPFDQSPEMKALLITEALEKALNENKQDFYRVNYANGDMVGHTGNYLATVQAMEFLDGCVERLWKTCEKQNIVLLVTADHGNADEMFQLDKKGNVEKDSHGNPIPKTSHTLNPVPISILDPENKIRFNSKLSNPGLANVAATILDVMGYETPEGYHPSLIQNES

SEQ ID NO: 18720 - protein, 802 aa, Arabidopsis thaliana
MTRFACFLFSTLLLSFSYAAITPTSPLSIGQTLSSPNGIFELGFFSPNNSRNLYVGIWFKGIIPRTVVWVANRENSVTDATADLAISSNGSLLLFDGKHSTVWSTGETFASNGSSAELSDSGNLLVIDKVSGITLWQSFEHLGDTMLPYSSLMYNPGTGEKRVLSSWKSYTDPLPGEFVGYITTQVPPQGFIMRGSKPYWRSGPWAKTRFTGVPLTDESYTHPFSVQQDANGSVYFSHLQRNFKRSLLVLTSEGSLKVTHHNGTDWVLNIDVPANTCDFYGVCGPFGLCVMSIPPKCKCFKGFVPQFSEEWKRGNWTGGCVRRTELLCQGNSTGRHVNVFHPVANIKPPDFYEFVSSGSAEECYQSCLHNCSCLAFAYINGIGCLIWNQELMDVMQFSVGGELLSIRLASSEMGGNQRKKTIIASIVSISLFVTLASAAFGFWRYRLKHNAIVSKVSLQGAWRNDLKSEDVSGLYFFEMKTIEIATNNFSLVNKLGQGGFGPVYKGKLQDGKEIAVKRLSSSSGQGKEEFMNEILLISKLQHINLVRILGCCIEGEERLLVYEFMVNKSLDTFIFDSRKRVEIDWPKRFSIIQGIARGLLYLHRDSRLRIIHRDVKVSNILLDDKMNPKISDFGLARMYEGTKYQDNTRRIVGTLGYMSPEYAWTGVFSEKSDTYSFGVLLLEVISGEKISRFSYDKERKNLLAYAWESWCENGGVGFLDKDATDSCHPSEVGRCVQIGLLCVQHQPADRPNTLELLSMLTTTSDLPLPKEPTFAVHTSDDGSRTSDLITVNEVTQSVVLGR

SEQ ID NO: 18721 - protein, 228 aa, Borrelia garinii PBi
MENQKMLVAKYAIDRYIKSNMNLGVGTGTTIYYAIKYLSEKIKSGNLKNLKLYATSSDTKYLLSKEQIPCESNFSKLNKNLDIAIDGADEILLEKKSLIKGMGGAHLMEKVIAYNSETLLIIADETKIVKKLGTKMSIPIEVAQNAVGFIMTRLEEMNLDTTLRVCKEKKGPIITDNNNYILDVKMHVENPEGTEKYFKLFPGILEIGIFNHKNTKIVYYQNKQIKEA

SEQ ID NO: 18722 - protein, 248 aa, Borrelia garinii PBi
MYKLVLVRHGESEWNKENLFTGWTDVKLSDKGINEALEAGLLLKQEGYSFDIAFSSLLSRANDTLNIILRELGQSYISVKKTWRLNERHYGALQGLNKSETAAKYGEGKVLIWRRSYDVPPMSLDESEDRHPIKDPRYKYIPKRELPSTECLKDTVTRVIPYWTDEIAKEVLGGKKVIVAAHGNSLRALVKYLDNLSEEDVLKLNIPTGIPLVYELDKDLNPIKHYYLGDESKIKSAMESVASQGKLK

SEQ ID NO: 18723 - protein, 407 aa, Silicibacter pomeroyi DSS-3
MSQSSECARPHRRGFDFCASAVFLCTQRAQSVGGCAMRGCPLLLWRPETCQNPAPFCRGFAAQGFTAVSVVSRAVTKTTFFDENLIERVLWQFTMKEQRANAIPATCRYARYSANPTPTPRPVKINESDRTMNFEEKIATHYGHGNLTAAIRSGLQAQGITPEQASVEDLGPVDEFHIGGRAATVHFFDQIDLSETSKALDIGCGLGGAARYAAHSFGSQIEGIDLTPEYVETGGALCQWVGLSDKVNLSVASALSMPFESGDFDIAYMMHVGMNIEDKRALFKEVARVLKPGGTFAIYDIMRSNDEDLVYPVPWASSAETCCLAGPATYRAALEEGGFVVRQENDRRDFAIDFFEKMKKANAGQKSPPPLGLHVLMQQTTAEKIPNMIANLQAGRIKPVEIYAVKQ

SEQ ID NO: 18724 - protein, 429 aa, Kineococcus radiotolerans SRS30216
MVRAVPAIVRAPHLFLAEVTRRHGPVAAIPLPRTPVLVLADPDGVRRVLVENARGYGKATIQYSALATVTGPGLLAGDGEVWKQHRRTVQPAFHHGSLEDVAAHAVHAARGLVAEADALPPGTPLEVLGATSRAGLEVVGHTLAAADLSGDAPLLVEAVGRALELVVRRAASPVPAAWPTPARRRLAREVAVIDEVCARIVATRRARPLEDPRDVVGLMLAAGMDDRQVRDELVTFVVAGHETVASSLTWTLDLLARAPSVLARVHAELAGALGGREPGWDDLGKLPLLRAVVDESLRLYPPAWVVTRQALADDVVAGVAVPAGTLVIVCTWGLHRDPALWEAPEEFRPDRFLDAPRPAAGSYVPFGAGPRLCIGRDLALVEEVLVLATLLCERTVRPAGPAPRVDALVTLRPRGGLPLHVERLAPSAS

SEQ ID NO: 18725 - protein, 202 aa, Triticum aestivum
MVDLQAAALVISVVAAEVQAIYLHSTAMAPTVMASSTTSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 18726 - protein, 301 aa, Escherichia coli
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRELHELADY

SEQ ID NO: 18727 - protein, 362 aa, Zea mays
  misc_feature (160)..(160): Xaa can be any naturally occurring amino acid
  misc_feature (214)..(214): Xaa can be any naturally occurring amino acid
  unsure (1)..(362): unsure at all Xaa locations
MPLRPLPVCTASINQQARSISHLTPPLPLQNLSIPRLAIHPSRIYTTGKSLLQKSLGQPGPPFSRHFHNTTSLQTAKTMTDTNVEAAKRAAAQQAVADHFDPAATHVGIGSGTTIVYVVEAIKQRSTNPNILFVPTGFQSRQLVVNAGLTAISFDSLPDXSYADVAFDGADEVDAELNCIKGGGACLFQEKLVAERARKFVCVADYRKRQNRLXTNWPTIPIEVAPLSQLKVAGALRMLGSTGPKLRTTLLEKSGPLKTDQDFYIIDAPFPPLLTSADVAAGKGKGDGTDGTWEVNTLSRAIKGLTGVLEVGIFSGLNGIDAQALREQDQSMKTVRGGQKPVAVYFGMQDGSIKVRTIEGET

SEQ ID NO: 18728 - protein, 271 aa, Burkholderia pseudomallei K96243
MTYLQESSRPAVTVPKLQAMREAGEKIAMLTSYDASFAALLDRANVDVQLIGDSLGNVLQGQATTLPVTLDDIAYHTACVARAQPRGLVVADLPFGTYGTPADAFASAVKLMRAGAQMVKLEGGEWLAETVRFLVERAVPVCAHVGLTPQSVHAFGGFKVQGKTEAGAAQLLRDARAVEEAGAQLIVLEAVPTLVAAEVTRELSIPTIGIGAGAECSGQVLVLHDMLGVFPGKRPRFVKDFMQGQPSIFAAVEAYVRAVKDGSFPGPEHSF

SEQ ID NO: 18729 - protein, 311 aa, Prochlorococcus marinus subsp. pastoris str. CCMP1986
MSIFLISSLVIFLTLLFSSLILWRINTRKYISSRTVATAYDSWTQDKLLERLWGEHIHLGFYPLNKNIDFREAKVQFVHELVSWSGLDKLPRGSRILDVGCGIGGSSRILANYYGFNVTGITISPAQVKRAKELTPYECKCNFKVMDALDLKFEEGIFDGVWSVEAGAHMNNKTKFADQMLRTLRPGGYLALADWNSRDLQKQPPSMIEKIILKQLLEQWVHPKFISINEFSSILINNKNSSGQVISSNWNSFTNPSWFDSIFEGMRRPNSILSLGPGAIIKSIREIPTILLMDWAFKKGLMEFGVYKCRG

SEQ ID NO: 18730 - protein, 659 aa, Oryza sativa (japonica cultivar-group)
MVGVLLLLSIMPLAAGELLAQLCGNGGNYTANGTYQSNLARLAAALPSNASSSPDHFATATAGQAPDAAYALALCRGDVANATACGDCVAASFQDARRTCPSDKSATIYYDDCLLRFAGDDFLAAPNITENATLFQAWNQQNITGDAAVAAANVRELLTVTARTAAAAARRFATGFMDGSSESKQTLYSLAQCTPDLAAGDCLACLQRLIAMVNSTTSVRLGGRVLLLRCNLRFEAFVFYAGEPTRRVSPPGSTPAPDSIAPTKNRKKSKSWVIAAIAAPVAAVVLCLIVCYYCRWSRRFRKDRVRLREKRSRRFRGDELICEMEGEISEFSVFEFREVIKATDNFSEENKLGEGGFGPVYKGLFSEGLEIAVKRLASHSGQGFLEFKNEVQLIAKLQHRNLVRLLGCCSQGEEKILVYEYLPNKSLDFYIFDERKKDLLDWNKRLVIIEGIAQGLLYLHKHSRLRVIHRDLKPSNILLDSEMNPKISDFGLAKIFGSNSNEGTTRRVVGTYGYMAPEYSSEGLFSPKSDVFSFGVIILEIISGKRNASLDQCEDFINLLGYAWKLWSEERWLELLDASLVTNWQSSCMLRCINIALLCVQENAVDRPTMSNVVAMLSSESMVLDEPKHPAYFHVRVTKNDESSTVGTCSTINDVTINY

SEQ ID NO: 18731 - protein, 479 aa, Exiguobacterium sibiricum 255-15
MNGKFLINGQWLDQGRERTDVKNPATGEVVGSVPNGTKSDVNDAVEAAHNAFPDWSKRTVYERAALLEKLYAKMLEKKDELARLMTLEMGKPLAESEGEVEYAANFVKWFAEEGKRAYGRIIPSHDATKRLHVIKQPVGVVAAITPWNFPAAMITRKLAPALVAGCTFVLKPPTATPLTALRLLELCQEVGIPDGVVNAVTGSGKDLGESLATHPHVAKITFTGSTEVGRTLMAQGAETIKAMSLELGGHAPILVFDDCDLDLAVRETIKSKFRNGGQTCVCGNRIYVSDSIYDEFVEKLGQETAKLKTGNGLDQETKIGPMINKAGYDKVKKHVDDATSAGARIVTGGSGQTDDDNDVYYYEATVLADVTPQMLIMNEETFGPVAPVQRVSSDEEAVHYANQTPFGLASYVFTNNYARAFKAIEHLDYGIVGWNDGVPSAAQAPFGGMKQSGVGREGGSEGLEAYLETKYVSIGGLDQ

SEQ ID NO: 18732 - protein, 131 aa, Schizosaccharomyces pombe
MSGGKSGGKAAVAKSAQSRSAKAGLAFPVGRVHRLLRKGNYAQRVGAGAPVYLAAVLEYLAAEILELAGNAARDNKKTRIIPRHLQLAIRNDEELNKLLGHVTIAQGGVVPNINAHLLPKQSGKGKPSQEL

SEQ ID NO: 18733 - protein, 614 aa, Zea mays
MCSASIFLPRCPNTMFQKNLLPLAAVLAVVASLMAAAAGYPWSVCGDSTDSSDFMPNGAYQAHLDFIAAALPKNASKSPDLFATVVAGTVPDQVWAVGLCRGDAKPTACFTCLTLAFQDLPGYCTYAKDASIYYDRCMVHYSDVHTLSGDDDTGPMMDRYAIGDTQTIASDPGRFVLLVAALVNATADYAAYGSGSAARRGFATGEADAGFDPEFPKLYALAQCMPGQTPALCRECLSRLISQSLDGFRNSIGGRVLAVSCTYRRRRRQPTAPRDKQQKDPVHSTEAEDIEMVESMMMDVSTLRAATGDFDESNKLGEGGFGAVYKGVLPDGEEIAVKRLSSSSSQGVEELKNELALVAKLKHRNLVRLVGVCLEQQERLLVYEFVPNRSLDLALFGADGREQPPLELDWGQRYRIINGIARGLQYLHEDSRLRVVHRDLKASNVLLDKNMNPKISDFGLARIFGRDQTQAVTSRVVGTYGYMAPEYMMRGNYSVKSDAFSFGVMVLEIVTGRKNSNDGCDLLTTVWMHWEAGTVAELVEPTSMGGSFPEGDVLRCIHIGLLCVQPDPAARPVMSSVVTMLGSDTVTLQAPSKPGFFARNNSAYTTVSTVPVDA

SEQ ID NO: 18734 - protein, 94 aa, Brassica napus
  misc_feature (31)..(31): Xaa can be any naturally occurring amino acid
  unsure (1)..(94): unsure at all Xaa locations
APRLEGQGQCRTSCVKVSVHPVTFMEDAAAXMALSPTGDFSMDACRLFNPRIRKKLSPQSEALGVTIFLFFVCKMLNPKMAPKFFFFFWKKDLQ

SEQ ID NO: 18735 - protein, 111 aa, Brassica napus
MSSGTVRRVSRQDIQLVQNLIERCLQLYMNQKEVVETLLEQAKIEPGFTELVWQKLEEENREFFNAYYLRLMVKHQIMEFNKLLEQQVRHMQQMHPSALTSVQNTNGSHIQ

SEQ ID NO: 18736 - protein, 92 aa, Pseudoalteromonas tunicata D2
MANTAHALHILVKHKEQADDIIAQLKKGAKFQTLAKKFSSCPSGKNGGDLGEFKRGQMVPQFDKVVFSCEVLEPQLVKTRFGWHVIKVLYRT

SEQ ID NO: 18737 - protein, 501 aa, Kluyveromyces lactis NRRL Y-1140
MESRLGWLTDLSTETGTNLRRTSIICTIGPKTNNPETLVELRKAGMNIVRMNFSHGSYEYHQSVIDNARKSEELYQGRPLAIALDTKGPEIRTGTTTNDVDYPIPPNHEMIFTTDDKYAKACDDKTMYVDYKNITKVIEAGRIIYVDDGVLSFEVLEVIDDNTLKVKSLNAGKICSHKGVNLPGTDVDLPALSEKDKSDLKFGVKNGVHMVFASFIRTAQDVLTIREVLGEQGKDIKIIVKIENQQGVNNFDDILKVTDGVMVARGDLGIEIPAPQVFAVQKKLIAKCNLAGKPVICATQMLESMTYNPRPTRAEVSDVGNAVLDGADCVMLSGETAKGNYPINAVKTMAETALIAEQAIPYIPTYDDLRNLTPKPTSTTETIAAASVSAVFEQKARALIVLSTTGDTPRLVAKYKPNVPIVMVTRNPRAARFSHLYRGVFPFVYDESSDSEWTVDVEKRINFGVKKAKEFGILVDGDTIVTIQGFAAGVGNSNTLRVLTV

SEQ ID NO: 18738 - protein, 573 aa, Kluyveromyces lactis NRRL Y-1140
MSNLQDLKDAGETSVVDKQTGQVYELDLTSYSNDSEKNGSLPNKPQSGDHNLKKGLKSAHIQLIAIGGCIGTGLFVGTSSTLYKCGPAGLFISYCIMSTIIYPVMNALAEMVCFLPGLPDENETGGSISTLCTRYVDSSLGFAVGWNYVYCYVILVAAECTAASGVVTYWTTAVPKAAWITIFLGIIVVLNCTAVEFYGTSEAIFCSLKIFCILGIIIVSIVLFFGGGPNHDRLGFRFWKDPGAWAYHLADGGAGRLSDIITGVIRAGFAFILGPELVVLTSTEAQDSRRNIEKAARRFVWRLIFFYCVSSLCAGVIVSRNDPVLLNALSQGKPGAGSSPFVIGIQNAGIKVLPHIINVCILSSAWSSGNSFMYATTRSLLSLSQEGYAPKIFNRVNRWGVPYTGVAFATAFSCLAYLNVSSSTADVFNWFSNISTISGFLGWICSGVAYLRFRKAVFFNNLYDRLPFKTPFQPYFTWFYIILIAIICLINGYESFVHWNYKDFIAAYITLPLFLILWLGHKAYTRTWSQWMISVSEIDVTTGLREIEEETKELNARRIPPRNLWEKILEWLF

SEQ ID NO: 18739 - protein, 154 aa, Bacteroides thetaiotaomicron VPI-5482
MIEKTLVILKPCTLQRGLVGEITHLFERKGLRLAGMKMMQLTDELLSEHYAHLSSKPFFQRVKDSMMATPVIVCCYEGVDAIQAVRTLAGPTNGRLAAPGTIRGDYSMSFQENIVHTSDSPETAAIELTRFFKPEEIFDYKQATFDYLYANDEY

SEQ ID NO: 18740 - protein, 296 aa, Mycobacterium avium subsp. paratuberculosis K-10
MTIPWTPDRLGDLTGRRVIVTGATNGVGLGTARALAKAGAEVILAVRNTELGKQRAAQMGGSTAVEKLDLADLSSVRAFADRIEAPVDILINNAGALTDRRTETVDGFEMTLGTNLLGPFALTNLLLPKVRSQIINVGSDAHRSATLHLDDLHLRRHKWTRLGAYAQSKLAVMLWGLELDRRLRAAGSPIVTQLTHPGWVASNLSNLGDAPLKAVAHKAVKVVADRLANDIDEGAAPTLYCISEPIPPGSYVGVSGRFGLRGGPVLIGRTPLACDYDTAARLVAFAERETGTELRV

SEQ ID NO: 18741 - protein, 496 aa, Chlamydia trachomatis
MFYSLIPVSRFMIARTKIICTIGPATNTPEMLEKLLDAGMNVARLNFSHGTHESHGRTIAILKELREKRQVPLAIMLDTKGPEIRLGQVESPIKVQPGDRLTLVSKEILGSKESALLFIQVVYSPYVRERAPVLIDDGYIQAVVVNAQEHMVEIEFQNSGEIKSNKSLSIKDIDVALPFMTEKDIADLKFGVEQELDLIAASFVRCNEDIDSMRKVLESFGRPNMPIIAKIENHLGVQNFQEIARAADGIMIARGDLGIELSIVEVPGLQKFMARASRETGRFCITATQMLESMIRNPLPTRAEVSDVANAIYDGTSAVMLSGETASGAHPVHAVKTMRSIIQETEKTFDYHAFFQLNDKNSALKVSPYLEANWVFWIQIAEKASAKAIIVYTQTGGSPMFLSKYRPYLPIIAVTPNRNVYYRLAVEWGVYPMLTLESNRTVWRHQACVYGVEKGILSNYDKILVFSRGAGMQDTNNLTLTTVHDALSPSLDEIVP

SEQ ID NO: 18742 - protein, 127 aa, Brassica napus
MASKPLNNIWIRRQQCPCGDWKCYIRLEGDESTTKTEIESTTSSSPSPSSSSSSPYVGQIFRTDEEAFEHYTTFARKTGFSIRKARSTESHNLGVYRRDFVCYRSGFNQPRKKPNVQHPRERKSLRC

SEQ ID NO: 18743 - protein, 397 aa, uncultured delta proteobacterium
MKLAERIARIKPSETLAITAKTNALRAQGRDVIGFGAGEPDFDTPVNIKNAAIKAIEGGFTKYTPVTGTDELKDAIVAKLKQDNSLDYKRSQIVVSCGAKHTLYNLAQALFEEGDEVIIPSPYWVSYPDIVVLAGASPVYVTTDEKDGFKMKPQQLSSAISERTRAVIINSPSNPTGAAYSPDELKSLAKVLLDKDILVITDDIYEKIFYADFAFANIASAEERIKDKTIVVNGVSKTYAMTGWRIGYAACSEEIASAMNKIQSQSTSNPTSIAQKAALEAISGDQSAVPQMVNEFSKRRDFIVGALNAIDGIKCFSPEGAFYVFPNVSGVYERAFQGKKITNSAEFIDFLLDEANVAAVPGAAFGSDDHIRLSYATSMKNIEEGIRRIKNAVSKLD

SEQ ID NO: 18744 - protein, 251 aa, Bacillus cereus ATCC 10987
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPAAAEAVRIQYGGSVKPENIKEYMAQSDIDGALVGGASLEPASFLGLLEAVK

SEQ ID NO: 18745 - protein, 252 aa, Bacteroides thetaiotaomicron VPI-5482
MRKNIVAGNWKMNKTLQEGIALAKELNEALANEKPNCDVIICTPFIHLASVTPLVDAAKIGVGAENCADKASGAYTGEVSAEMVASTGAKYVILGHSERRAYYGETVAILEEKVKLALANGLTPIFCIGEVLEEREANKQNEVVAAQMESVFSLSAEDFSKIILAYEPVWAIGTGKTASPEQAQEIHAFIRSIVADKYGKEIADNTSILYGGSCKPSNAKELFSNPDVDGGLIGGAALKVSDFKGIIDAFNA

SEQ ID NO: 18746 - protein, 334 aa, Bacillus cereus ATCC 10987
MTKIGINGFGRIGRNVFRAALNNPEVEVVAINDLTDAKTLAHLLKYDTVHGTLNAEVSANESSIVVNGKEIKVIAERDPAQLPWSDYGVEIVVESTGRFTKKADAEKHLGGSVKKVIISAPASDEDITVVMGVNHEQYDAASHNVVSNASCTTNCLAPFAKVLNEKFGVKRGMMTTIHSYTNDQQILDLPHKDLRRARAAAENMIPTSTGAAKAVALVLPELKGKLNGGAVRVPTANVSLVDLVVELDKEVTVEEVNAAFKAAAEGELKGILGYSEEPLVSIDYNGCTASSTIDALSTMVMEGNMVKVLSWYDNETGYSNRVVDLAAYMTSKGL

SEQ ID NO: 18747 - protein, 277 aa, Triticum aestivum
AYLGDTIEQVCTKKQAGTGPEFPGYRRPTRPLDLDSPTEGFSSISEAIEDIRQGKLVIVVDDESRENEGDLILAASLVTPEAMAFIVRHSTGIVCVSMKENDLERLNLPLMVSTKENEEKLCTAFTITVDAKEGTTTGVSAKDRAKTVMTLASPYSKPEDFNRPGHIFPLKYRDGGVLKRAGHTEASVDLAVLAGLPPVGVLCEIGDEDGSMARLPKLRLFAEKNNLKIVSIADLIRYRRKRDRLIERASVARIPLRWGNVRAYCYRSVIDGIEHIA

SEQ ID NO: 18748 - protein, 336 aa, Arabidopsis thaliana
MDLASNLGGKIDKSDVLTAVEKYEQYHVFHGGNEEERKANYTDMVNKYYDLATSFYEYGWGESFHFAQRWKGESLRESIKRHEHFLALQLGIQPGQKVLDVGCGIGGPLREIARFSNSAVTGLNNNEYQITRGKELNRLAGVDKTCNFVKADFMKMPFPENNFDAVYAIEATCHAPDAYGCYKEIYRVLKPGQCFAAYEWCMTDAFDPDNAEHQKIKGEIEIGDGLPDIRLTTKCLEALKQAGFEVIWEKDLAKDSPVPWYLPLDKNHFSLSSFRLTAVGRFITKNMVKILEYIRLAPQGSQRVSNFLEQAAEGLVDGGRREIFTPMYFFLARKPE

SEQ ID NO: 18749 - protein, 512 aa, Aspergillus nidulans FGSC A4
MALLGLLETYRDPLAFVAALSAVFYLLSCLHRRWRRYQFAKENGCEPVVGKIPSYDPFLSLDRLYRLTKLARNRKLLENNVQRFKEFGNTHRAKRITTPMIVTRDPQNIKAILSLKFGDYSMGDRIRIFGPLLGHGIFTSDGEDWARSRHMIRPNFVKEQVAHLEIFEELMDDLFALIPTDGSTVDLQELFFGFTIDSATEFLCGHNVHSLKKRRSGVIDDEPDFAEAFNYSLDNISKNGRFGPLMFLNRDPKAVESHRICHESMDQFVDKAIRMRERYNEEKIVDEAAERRYMFLYGLAQQTGDRRRIRDEVLNILLAGRDTTASLLSNMFFLLAKHPSTWAKLQEEVATLEGRAPTYEQLRNMKYLKYCLNETLRLFPVVPVNSRTAIRDTVLPVGGGPDGQSPAFVPKGTMVAYSVYAMHRREDYYGADAEEFRPERWADLRPGWEYLPFNGGPRICVGQQYALTEAAYVTTRLAQRYSILESRDPGPWEEKLTLTLCSYNGTQVSLRH

SEQ ID NO: 18750 - protein, 151 aa, Brassica napus
FVIVDDAGKAVGPIVDGDAVVTFNFRADRMVMHAKALDYEDFDKFDRVRFPKIRYAGMLEYDGELKLPSRYLVSPPEIDRTSGEYLTHNGVSTFACSETVKFGHVTFFWNGNRSGYFNEKLEQYVEIPSDSGISFNVKPKMKALEIAEKAR

SEQ ID NO: 18751 - protein, 472 aa, Salmonella choleraesuis
MITPIIMAGGNGSRLWPLSRTLYPKQFLCLDGSQSMLQTTITRINNLNASDPIVICNEQHRFIVAEQLKELSKSSGDIILEPVGRNTAPAVALAALKCLKKNALLLVLAADHIIKDEETFCKTIQDARKYAEAGKLVTFGIVPTMPETGYGYIRRGQALFSAENDCSLAFRVAEFVEKPNLETAQSYLDSGEYYWNSGMFLFFRADRYIEELKIRPDIYKACSLAMESAVTDLDFIRVDEDSFCACPDESIDYAVMEKTNDAVVVPLNAGWSDVGSWSSLWEISDKDSNGNVTKGDVLSHNADNCYLHAETGLVTAVGVKDLIVVQTKDAVLVANTNCVQDVKKIVEKIKLENRHEHITHREVYRPWGKYDSIDFGERYQVKRITVKPGEGISEQQHYHRAEHWIIVAGTAKITIKGEVKILTENESVYIPVGVKHCLENPGKIALELIEVRSGAYLGEDDIVRFSDKYGRN

SEQ ID NO: 18752 - protein, 333 aa, Rhodobacter sphaeroides 2.4.1
MKPFPTHPDAIPAELQDVMDRLGSVAIEVANRIARGGIDEDLAGLCGTNTDGDGQKALDVIADDAFRVALEGSAVRFYASEEQDTAVTLNEAGTLALAIDPLDGSSNIDTNLSVGTIFAIWPAAATAEASFLRLGSELIAAGYVIYGPQVCMMVSFGKGTQKYVLDPGSRSFVLVDRAVKVPPSSTEFAINASNYRHWPKPIRAYIDDCVAGTEGPRGRNFNMRWLASLVAETHRILARGGVFLYPRDSRKGYEQGRLRYLYECAPIAFVITQAGGGATDGENPILGQTPSRLHARTPFVFGSAEKVARITAYHDLPEQETSALFGNRGLFRS

SEQ ID NO: 18753 - protein, 653 aa, Neurospora crassa
MVLAKSKKSVGLGNTLMNDRFGKGKGSDRKRVSAVTRIDHATGKEYITNDKQDAAWVKMRSITEQGALDEFLATAELAGTDFTAEKMNNVKIIHTDQRNPYLLSAKEEQAVLGKQRANKSRLTVPRRPQWDSTTTRDELDQRERESFLEWRRGLAELQETQDLLMTPFERNLEVWRQLWRVIERSDVIVQIVDARNPLMFRSEDLEVYVKDVDPKKHNLLLINKADLMTYKQRKMWANYLKGEGIDYRFFSAQLAKEMIEAGGYADSDEDSEDESDAGEGPSKQEETPKAEEKASEENEEAKEEEITEHNDPDTHILRVDELEDILLQYQPEGQDRKLQVGLVGYPNVGKSSTINALIGAKKVSVSSTPGKTKHFQTIHLSDNVLLCDCPGLVFPNFANTKAELVCNGVLPIDQLREYTGPAALVARRIPQPFLEAVYGIKIKTRPLEEGGTGIPTADELLDAYARHRGYMTQGLGQPDQSRAVRYILKDYVNGKLLYCEPPPGSGVDGPEFNAELYDMAHLPENRRVAMLSALEGADIDDTATLTSEMTALALPQGQKSKKLDKAFFKSGGNGGHIQQAFHQKYSQQGQAQNMVKHMSGRKLRALIAAEQGVNVKEVQMEMGGKKHFKGGMGLKGGKGKRRAGRSGNNDDDD

SEQ ID NO: 18754 - protein, 411 aa, Streptomyces hygroscopicus
MTDHTGALRLDNSMKLLARGRLVDATLSEKDYVIERDRLVEGAYPVYGERARGARVWDADGNEYLDYILAYGTIILGHADPAVTKAAQQEIEEGFSITLRKRTHIELAERLVRIIPGAERVFLLKTGSDATSAAVRLARAYTGRDRVVRWGYNGWHDWAAQRPGGIPDTVRTQVDTFRYNDLDDLREVFRRHAGQVACLLLMPFELDSPEPGFLQGAIDLAHEHGALVVFDEMRSGFRVALGGAQELYGVRADLATFSKAMANGWAVSALTGRAEVMAMVGQTHISSTFYSNTVSMAAAVATIDQLADGTVLDRVRRLGVRLQSGLTELVGRHGVPARVRGVPQMPFLAFTHPDPGRSRAMQDAFFAETTRRGVLLHPTHHWFVCAATTDADLEHTLAACDAAFEVAAKVA

SEQ ID NO: 18755 - protein, 447 aa, Kluyveromyces lactis NRRL Y-1140
MIVTSKSVTSKRRPSINKTFSDVNFVNQVQIPFQENYRSHKHSTSFNEVRRLQNQTWKEQFVNLFPKDVQEYLPEVNVHISILCLIWYMTSSVSSNLSKAILSRFPHPVGLTELQFLLSASLCLAFVTFANYLHAPQVSSSKLKNTVLNFPEGILPTYLNGSFSRCILNTFLVPSKVIWYTTFPMGIFQFVGHITSHKSTSLIPVSLVHSVKALSPIATVCYYRFAKGRQYNNMTYYTLIPLILGVIITCWTSQNNKSKLTETDKTTFSMGLSFAFISMVIFVSQNIFAKGILTVKSKDVLPCKNKSQLNLVELKSQKDSPIQLDKITILFYCSCVGFILTFPIFVSNEVFSSSTSVFADLSPSVMTLVLIHGVAHFFQAMLAFQLIGMLSPVTYSIANIMKRIVIIGVAFIWESNLSINQLFGLILTISGLYGYDKWGNKKVNCSL

SEQ ID NO: 18756 - protein, 222 aa, Triticum aestivum
MSGVFGRVFGKSKEQSQASALASIDKLSETLEMLEKKENLLMKKANLEVEKAKAFTKAKNKKAAIQCLKRKRLYEQQVEQLGNFQLRIHDQMIMLEGAKATTETVDALRTGASAMKAMHKSTNIDDVDKTMDEINDNMENMRQIQDLLSAPMGAASDFDEDELEAELADLEGEELEAQLLAPTTSAPMTAPARVPQQSSRPTAQSSKTEDDELAALQAEMAM

SEQ ID NO: 18757 - protein, 341 aa, Chlamydia trachomatis
MTTWDLAMRIVINGFGRIGRLVLRQILKRNSPIEVVAINDLVAGDLLTYLFKYDSTHGSFAPQATFSDGCLVMGERKIRFLAEKDVQKLPWKDLDVDVVVESTGLFVNRDDAAKHLDSGAKRVLITAPAKGDVPTFVMGVNHQQFDPADVIISNASCTTNCLAPLAKVLLDNFGIEEGLMTTVHAATATQSVVDGPSRKDWRGGRGAFQNIIPASTGAAKAVGLCLPELKGKLTGMAFRVPVADVSVVDLTVKLSSATTYEAICEAVKHAANTSMKNIMYYTEEAVVSSDFIGCEYSSIFDAQAGVALNDRFFKLVAWYDNEIGYATRIVDLLEYVQENSK

SEQ ID NO: 18758 - protein, 431 aa, Triticum aestivum
MAATRLPLLLLLLAATVAAAADLSVYHNVHPHSASPLESIIALARDDDARLLFLSSKAASAGAASAPVASGQTPPSYVVRAGLGSPAQPMLLALDTSADATWAHCSPCGTCPASSLFVPANSSSYAPLPCSSSMCPILQGQPCPDRDPFDSAAPLPSCAFSKPFADASFQAALASDWLHLGKDSIPNYAFGCVGSVSGPTSNLPKQGLLGLGRGPMALLSQVGNMYNGVFSYCLPSYKSYYFSGSLRLGAAGQPRAARYTPMLRNPHRSSLYYVNVTGLSVGRSPVKVPAGSFAFDPSTGAGTVVDSGTVITRWTAPVYAALREEFRRHVAAPSGYTSLGAFDTCFNTDEVAAGGAPAVTIHMDGGVDLALPMENTLIHSSATPLACLAMAEAPQNVNAVVNVVANLQQQNLRVVFDVANSRVGFARESCN

SEQ ID NO: 18759 - protein, 480 aa, Cryptococcus neoformans var. neoformans B-3501A
MPASQPLQLLFLGTATSTGLPLTPCLTLSTPYPHRWSNMVPLLQGRDLSDRSPSPASTTSSSTYSGSTYDPEGQWPKNIPCACCRSTVDPDVPEGWKNKRGNTSVLLRKQSAEGDWKNVLVDVGKTFREQAMRFFPTWGVKTIDAVLLTHGHADAYFGLDDLREWCVRQGKAIPVYLNKETFHKVEETFPYMVDKTKVSGGGDVPQLIWKIIEDEGEFQVEGIDVKVLPVHHGIYFHSILPPTNAEPVREPPAKIEPEPLICLAFEFDDSIIYMSDVSGIPQRTWDRMLQTSSRRQTIFPTPVDSRGGDDTPKGVPKNQSISDLANLSISPRVPGRLEQLRTHNVPVLIIDALWPLQPHASHFSLAQALIAALRLRAANTYVIGSTHPTSHFMWEEICNSLTHRDGRDYEVRDHPDAAQAEWLVKRVWDKVFGEGEHEGLGERWMEEGGKVKPAWDGLVIEVGGDQGLERADLSSKGLLI

SEQ ID NO: 18760 - protein, 792 aa, Debaryomyces hansenii CBS767
MSSKTSSSASKKKATSTPASESSTKKVKIPKNYIVRPSPNNSARSSNKVFINSEILQALEISNGSIVYISKVSGGEAGVLGTIHSDNDIIDKNVIGISSSLRCLGGLLLGDRIQIDKYLSQPEYATSVDLRIENDQNESIKIEGKVSKALEKLFNEIGIVFPGLKLTKVSIPNNEGGNEEEDIKMSCTIKVIDVLGKESLEDSLNKLSINEEKESEICNSLTVSPAYIFSKGKTQINTSVIREPLRSKFPQLPQPVGYSQVGGLSRPIALLQSTIELPLHNPTLFSDFGISPPRGILLHGPPGTGKTMLLRCVANETNAHVLTVNGPSIVSKYLGETENAIRDIFEEARKFQPSIIFLDEIDSLAPNRNSDDSGETESRVVATLLTMMDGMGDTGRIVVVGATNRPNSIDPALRRPGRFDQEVEIGIPDVEARGDILIKQFDKMDKSKFDLTKEEINSIASKTHGYVGADLTALCRESVMKAINRSLKASIPQREIKLELRDVEEALPEIRPSAMREIFLEMPKVYWSDIGGQEELKQKLTEVVQLPLEAADTFNKLGVLAPKGVLLYGPPGCSKTLTAKALATESGLNFLAVKGPEIFNKYVGESERTIREIFRKARAASPSIIFFDEIDAISGDRESSGTSASQNVLTSLLNEIDGVEELKGVVIVGATNRPTEIDPALLRPGRLDRHIYVSPPDYDARLQILTKGCSKFNLDGREVNLSTLADLTNGCSGAEVALLCHEAGLSAVMEDKQATCVEQRHFDHALKGISKGITQDMLDYYKTFSSRSGLSI

SEQ ID NO: 18761 - protein, 349 aa, Anabaena variabilis ATCC 29413
MAKASESLDLSVNESTDKALDRDCTTLSRHVLQQLQSFSADAQDLSALMNRIALAGKLVARRLSRAGLMEGVLGFTGEVNVQGESVKKMDVYANDVFISVFKQSGLVCRLASEEMDEPYYIPENCPVGRYTLLYDPIDGSSNTDTNLSLGSIFSIRQQEGDDSDGQAKDLLTNGRKQIAAGYILYGPSTMLVYTMGKGVHSFTLDPSLGEFILSEENIRIPDHGAVYSVNEGNFWQWEESMREYIRYVHRTEGYTARYSGAMVSDIHRILVQGGVFLYPGTVQNPEGKLRLLYESAPLAFLIQQAGGRATTGLVDILDVVPKKLHQRTPLIIGSKEDVAKVESFIQNGH

SEQ ID NO: 18762 - protein, 187 aa, Zea mays
MAGATTPASGALVRLCLPSLLLFLYRCCRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSTLCHFSIRAMCGLDSEKNCVHGSDSPESADREISFFFGEAESVTVEHDEL

SEQ ID NO: 18763 - protein, 245 aa, Parvularcula bermudensis HTCC2503
MIQNMGDGDVRRLIAGNWKMNGLEDDLAEVTTLAQRLETPRPDNVDVVICPPATLIAPMHALQFDTIGLGAQDCHTEESGAYTGDLSAAMLRDAGACYCIVGHSERRDYHGETDEVVKAKLAAALKADLIPILCVGENLETREAGKAVDTVVAQLKAAFPGAGKGVVVAYEPIWAIGTGKTAGPAEIEEMHAALRQATSPDTRLLYGGSVKPGNAAEILAVSNVNGALVGGASLKADDFEPIVRA

SEQ ID NO: 18764 - protein, 504 aa, Oryza sativa (japonica cultivar-group)
MAGGRAFRPSAPRRAAFAALLTLLLLATLSFLLSSPPPTHASHRSSYLGASPPSRLAAIRRHAADHAAVLAAYAAHARRLKEASAAQSLSFATMSSDLSALSSRLASHLSLPEDAVKPLEKEARDRIKLARLLAADAKEGFDTQSKIQKLSDTVFAVGEHLARARRAGRMSSRIAAGSTPKSLHCLAMRLLEARLAKPSAFADDPDPSPEFDDPSLYHYAVFSDNVLAVSVVVASAARAAADPSRHVFHVVTAPMYLPAFRVWFARRPPPLGVHVQLLAYSDFPFLNETSSPVLRQIEAGKRDVALLDYLRFYLPDMFPALQRVVLLEDDVVVQKDLAGLWHLDLDGKVNGAVEMCFGGFRRYSKYLNFTQAIVQERFDPGACAWAYGVNVYDLEAWRRDGCTELFHQYMEMNEDGVLWDPTSVLPAGLMTFYGNTKPLDKSWHVMGLGYNPSISPEVIAGAAVIHFNGNMKPWLDVALNQYKALWTKYVDTEMEFLTLCNFGL

SEQ ID NO: 18765 - protein, 402 aa, Pleurotus eryngii
MLRLILLAAVASASLASPFFSQPSDLATRAVSLTSSCSTTGSASCHNTSSVSNLCCFESPGGLLLQTQFWDTNPSTGPSDKWTIHGLWPDNCDGTFEQNCDPSRAYTNIASLLSSGGASDTLSFMQTNWVDINGQNEQFWAHEWSTHGTCMSTLHTSCIPSGSVRGTEAVAFFQTVVKLYKTLPTFDWLAGQGIRPSTTQTFTLATLTSALKTASGGFTPALDCSSGALNQISWYFNLRGSIIDGTFVPINAPKAGSCPSSGIRYPPKTGSGTPTTPPSNPGGLPTRATIHAIRSGSQTGGLLTLGTWSSQTLATFTLTGTASSFTMTSSKGNCGVSGGSFSCGSGVSPTTFSAVTSGSDLLLASGGSTAWGSDGIPSGSTVFTVFTGSSHSQDYTLTIVGA

SEQ ID NO: 18766 - protein, 235 aa, Triticum aestivum
  misc_feature (208)..(208): Xaa can be any naturally occurring amino acid
  unsure (1)..(235): unsure at all Xaa locations
MTPSLQDAKITFLGGGNMAAAIIGGLLAKNTNKQNIYVSEPWDVNRNKMADLGVRTTADNKEAAADADVVILAVKPQVAKGVCEELSSAWAGRDSLPVVISIAAGITLASIAQWFKGDSGKAPHIVRVMPNTPALVGEGASGLYAAEDVTAAEKELTSALLGSVSKATEWVDKEELLDVVTGISGSGPAYFFAFVEHLISSGVSLGLXREQATRLATQTCLGAGKMLVESSDEPS

SEQ ID NO: 18767 - protein, 270 aa, Burkholderia pseudomallei K96243
MKIAFIGGGNMAAALIGGLVKRGVDASGLLAVDVNEDARQRAQAQFGVRTAAAVDATLAGYDAIVLAVKPQVLKDVALALAPHLTTQLVVSIAAGIRGADLSRWLGDYPRVVRTMPNTPALVGLGVTGLSALPGVDAAGRDLASKVLGAVGETVWFDDESQLDAVTAISGSGPAYVFYFIEALQEAARQLGMNDEQGRALAVATFAGAAQLAVQSGEPAGVLRERVTSKGGTTAAALASFDAQHVKDAIVRGVLAAQARAREMGDELGGA

SEQ ID NO: 18768 - protein, 428 aa, Idiomarina baltica OS145
MSRSEQLFTQAQISIPGGVNSPVRAFNGVGGSPIFIERADGAYMFDADGQRYIDYVGSWGPMILGHNNQVVLDATITAAQRGLSFGTPTEVEITMAEKIRELVPSIEKVRMVNSGTEATMTAIRLARGYTGRDKILKFEGNYHGHADALLVKAGSGALTLGVPNSPGIPEDFAKHTLTVEYNNIDSVKDIFAQYGDQIACIIVEPVAGNMNCIPPVPGFLEGLRTICDDYSSVLIFDEVMSGFRAAPGGAQERYNVTPDLTTLGKVIGGGMPVGAFGGKKEVMDHIAPTGPVYQAGTLSGNPVAMSAGLAALSQLSQEGLYEQLYARVDQLLDGMQQLADEAGIPFTTNRAGSMFGFFFTKEKQVTSYKQATECNMEHFKAFYHSMLKQGVYLAPSAFEGGFMSAAHSEQDIEDTLAAAKIAFSELSA

SEQ ID NO: 18769 - protein, 336 aa, Frankia sp. EAN1pec
MTAATSGAGGPATGAGAVAGPGFDRESTALEVARSADLRGRVAVLTGASSGIGVETARALAATGADVVLGVRDVAAGEELVREVRAGATGDIRAERLDLSDLGSVVAFAAQVTGPVDLLIANAGVSRTPESHLPNGLDVRFATNHLGHFLLALRLSEQLAERGARIVVVSSGAHRSIPVRLDDLQWTARRHNPGMAYAESKTANILFAQEATRRWGPDGIFANAVLPGSALTGLQRFHGDEMKRRIGFLNEDGSPNPVLKSPAQAAATTLWAATAPELAGRGGLVLEDCAEALPPGPPGSDVLVRSGFDPSVADPDTARRLWDRSIELLRVLGRPE

SEQ ID NO: 18770 - protein, 149 aa, Glycine max
  misc_feature (131)..(131): Xaa can be any naturally occurring amino acid
  unsure (1)..(149): unsure at all Xaa locations
MDHQADTNRTDLMTITRFVLNEQSKYPESRGDFTILLSHIVLGCKFVCSAVNKAGLAKLIGLAGETNVQGEEQKKLDVLSNEVFVKALISSGRTCLLVSEEVEEAIFVPSSHRGKYIVVFDPLDGSSNIDXGVSIGTIFGIYMVKNEGE

SEQ ID NO: 18771 - protein, 471 aa, Frankia sp. EAN1pec
MPRRAKIVCTLGPATNSPEMVRALVDAGMDIARLNFSHGTHEQHAAAYALVREAAAAAGRSVGILADLQGPKIRLGRFADGGVTLLPGQHFTVTIRDVLGDQEQVGTTYPGLTRDVAAGDTILVDDGRLNLRIDGVEDTDVRTTVVIGGKVSDNKGMNIPSAALTVPALSEKDADDLRFALELGVDMIALSFVRSAEDYAAVRSIMDEVGIRVPVLAKIEKPQAVDELDGIIEAFDGLMIARGDLGVELPLEDVPLVQKRAVSQARERAKPVIVATQVLESMVSAPRPTRAEASDCANAVLDGADAIMLSAETSVGSYPVESAATMARIIETAEADLGRIPPLRTPPRTLGGAIAQAAVSVGEAVGARYLVAHTLSGDTARRLIRYRSSVPVIAFTPIPSVRSQMALLWGVETVLVPFAESTDEMVRQVDTALQQVGHCRPGELVVVVAGTPPGVAGMTNAMRVHRIGEAV

SEQ ID NO: 18772 - protein, 153 aa, Yarrowia lipolytica CLIB122
MASQKRLIKELAAYKKDPNPCLASLTADGDSLYKWTAVMRGTEGTAYENGLWQVEINIPENYPLQPPTMFFRTKICHPNIHFETGEVCIDVLKTQWSPAWTISSACTAVSAMLSLPEPDSPLNIDAANLVRCGDESAMEGLVRYYVNKYASGN

SEQ ID NO: 18773 - protein, 501 aa, Xanthobacter autotrophicus Py2
MQAFAQLLENGRAGPCRPFPRAEVSAEQWTALAGHLAAGELVLMGLWGDAGAVHMALLDEASGRLAVATFACVGGTFPSVARHHPPAARLERTVRDLYGLVPEGAPDERPWLDHGRWGTRQPLGANLPAEPEGDAYLFLAAEGEGLHQIPVGPVHAGIIEPGHFRFSCYGETVVRLEARLGYVHKGIERLMAGADVAQAARLAGRQSGDSTVAYALAFSRAVEAARGVGVPARAHALRGVMAELERLANHLGDIGAICNDAAFALMLAHCGVLREKVLRVCARAFGHRLMMDGVIPGGVAGDLARDGVSAIRVLVSEVRAAFPALVELYDNTASLQDRTVGTGFTRPDYVRQFGAGGFVGRASGRPFDARRALAYPPYDRLPFEVVVRSEGDVNARIWVRIREVEQSLGLIVRLLDTLPDGPVAVEVPAGPGEGLAVVEGFRGDVLAFVALEADGRVRRAHLRDPSWFQWPLLETAIEGNIVADFPLCNKSFNCSYSGVDL

SEQ ID NO: 18774 - protein, 448 aa, Kineococcus radiotolerans SRS30216
MTAPTPAPTTSSAPTSAALFERAAAVIPGGVNSPVRAFRAVGGTPRFTASARGPYLTDADGREYVDLLCSWGPMILGHAHPDVLAAVTAAAQDGFSYGTPTEREVLLAEEIVARVEPVEQLRMVSSGTEATMSAIRLARGFTGRPVIVKFAGHYHGHVDALLASAGSGLATFALPDTPGVTGTAAGDTIVIPYNDPEALAEVFRLHGDRIACVITEAAAGNMGVVAPQPGFTAELRRVTREHGALLVSDEVMTGFRVSAAGWYGHEGLGLEHAPDLLTFGKVMGGGFPAAAFGGRADVMAHLAPAGPVYQAGTLSGNPIATAAGLATLRACTPEVYAAVETAATAVREAASAALSAAGVPHLVNTAGSMFSVFFTGLDAVTDYEQARQQDLGAFRAFFHSMLDQGVHLPPSAFEAWFLSASHDEAAIGRVVEALPAAARAAAEGSGSL

SEQ ID NO: 18775 - protein, 218 aa, Vibrio cholerae O1 biovar eltor str. N16961
MNQSSLLAEFGDPITRVENALQALREGRGVLLLDDEDRENEGDIIYAVESLTTAQMALMIRECSGIVCLCLTEAQADRLALPPMVVNNNSANQTAFTVSIEAKHGVTTGVSAQDRVTTIKTAANPQAKPEDLARPGHVFPLRARAGGVLARRGHTEGTVDLMQMAGLQPAGVLCELTNPDGSMAKTPEIIEFGKLHNMPVLTIEDMVQYRIQFDLKLA

SEQ ID NO: 18776 - protein, 483 aa, Sulfolobus tokodaii str. 7
MKSHIILRLFLHTLTLPNALSSPILSVSKVYQSSRPSSSIRYYTSSLLIISHTVIKNMSVSELLRKNNVEILRFTWVGLDGIIRSKGAYIDEVDNLVKTGIGLTMAMMSFTPMDYISPYGTFGPQDEDVFLTPDLSTLSIFPPSAVVLCYLYKGSSPWMYDPRSTLKKILEKYSEYEFKSSFEIEFYLVKDRKPFDDTKCFDSRAYYNNQIIPEIAKVAGSVGIVPLRVIKEYGPGQYEFDIQHKDAMRSADEVILFKEIARQIASKYNVEANFMPKPFNKMAGSGLHLNFSIWKDGRNLFYDPNDNYGLSDLAYNFIAGIIEHAKALTAIAAPTVNSYKRLVPGSWAPTKITYGYNNKSAMLRIPTPYPGMSMQDRRIEYRVPDATTNPYLLLSAFIEAGIDGIERGLKPPSPVNENAYFRKDIEDVPRNLREALNELKKDTRLIERVGREIVEEFIRVKMAEVEEFESLVTDWEYEVYKYV

SEQ ID NO: 18777 - protein, 545 aa, Zea mays
MSAMDTAVSQNATVAAAATAAGVGSAGLAGLLPEVQTVELLVAVSIFVAIHSLRQRRTQGLPTWPLVGMLPSLLLGLRSDMYEWITGVLKARGGTFTFRGPWLTNLHCVVTADPRNLEHLLKTRFGSFPKGPYFRENMRDLLGDGIFGADDEVWRRQRKAASLEFHSAEFRALTASSLVELVHRRLLPVLPGAEAAAGAVDLQDVLLRLTFDNVCMIAFGVDPGCLRPGLPEIPFARAFEDATEATTLRFVTPTAAWRAMRALGVGHERVLRRSLAAVDEFAYDVIRRRREELGGDDAGAGRRSSDLLTVFTRMRDEDGRPYTDKFLRDICVNFILAGRDTSSVALAWFFWLLGKNPGVEAKILEEVEGIVAARKGAGEVVEEEEELVFRPEEVKRMEYLHAALSEALRLYPSVPVDHKEVVEDEVFPDGTVLKKGTKVIYAMYSMGRMESIWGDDCREYKPERWLRDGRFVGESAYKFTAFNGGPRLCLGKDFAYYQMKFTAASILRRYRVRVVEGHPVAPKMALTMYMKHGLKVTLTKRGKAN

SEQ ID NO: 18778 - protein, 99 aa, Glycine max
MKTGNRFVGIAHAKQKLQRTLSQRIKMASAVADVPKGHLAVYVGENHKRFVIPISYLSHPLFRDLLDWAEEEFGFNHPMGGLTIPCTEDYFISLTSSLN

SEQ ID NO: 18779 - protein, 351 aa, Myxococcus xanthus DK 1622
MRANVFQAVNRFGIEEVERPRAGAGEAVIRMTMTTVCGTDLHIVRGEYPVRPGLVIGHEPVGVIEELGPGVTDYRPGQRVLVGAITPCGQCRACLSSHLSQCGHGAGYEALGGWRMGNTQDGAQAEYIRIPAAQANLAPIPDGLTDEQVILLSDIASTGFSGAEAGSVRIGDAVVVFAQGPIGLCASIGARLMGASLVVGVDGDEARMKMAQRMGVDVVLDHRQQDVVAEVKRLTGGGADVAIEALGTQQTFESALRCLRPAGTLSSLGVYSGKLQLPYDAFSAGLGDYRIVTTLCPGGKERMRRLMDLVHHKRVDLSPLITHRFKLADIQEAYALFGERRDGVFKVAIQP

SEQ ID NO: 18780 - protein, 588 aa, Geobacter sulfurreducens PCA
MHDLGLIMTITGSFTAALLLGYLTHRLGMSSIVGYLLAGIAVGTHTPGFVADLGMAEQFAEIGVILLMFGVGLQFHVKELLDVRRVAIPGAVCQSAVATLLSCLLARWLGWSWSAGIVFGFAVSVASTVVLLRVLVDNNELHTPTGHIAVGWLVVEDIFTVFLLVILPIFFGSGVAGSDSLPLAIGLSVVKIALLVALTFFVGSRLIPRLLWHVAATRSRELFTLTVLVLALGIAVGSAKLFGVSMALGAFLAGMVVRQSDFSFRAASEALPMRDAFAVLFFVSVGMLFNPTYLMEEPGLVLATLVIILVGKPLAALVIVLVLGYAPRVALSIAVALAQIGEFSFILATVGKDLGVLGEGGANTLVAASIISISLNPLLYRLIGPLEKKARHWRLWRMLDERAKSRTTGSAEDAGSHVLTSRNRAIVVGYGPTGRTLARLLSENGIDPVIIEMNLHTVRQLNADGTLAIYGDATREETLKGAGVESAVAFILTSAGMQGSDEAIRLARELNPNLRIIARAAYLRDIPALRRAGADAVFSGEGEIALNMTEHMLNKLGATPEQIDRERERVRSELLGGTPAVTPLATDH

SEQ ID NO: 18781 - protein, 144 aa, Guillardia theta
MSSTGRLLKEYNDIKKNIEININIKPYEDDLYKWKGFIIGPNGTPYQGKSFNIECSVPLSYPLSPPKITFVDQIFHPNVYPSNGEICLDILKNQWTPAWTILFSCQAIIVLLTNPEPNSPLNCDAGNFLRSKDYRGFSSIAKFI

SEQ ID NO: 18782 - protein, 528 aa, Mycobacterium avium subsp. paratuberculosis K-10
MNLPVVLIADKLAESTVAALGDQVEVRWVDGPDREKLLAAVPEADALLVRSATTVDAEVLAAAPKLKIVARAGVGLDNVDVDAATERGVLVVNAPTSNIHSAAEHALALLLAAAREIPAADASLREHTWKRSSFSGTEIFGKTVGVVGLGRIGQLVAQRLSAFGTHLIAYDPYVSPARAAQLGIELLSLDELLARADFISVHLPKTPETAGLIDKDALAKTKPGVIIVNAARGGLVDEAALADAVRSGHVRAAGLDVFSKEPCTDSPLFELPQVVVTPHLGASTTEAQDRAGTDVAASVKLALAGEFVPDAVNVAGGTVNEEVAPWLDLVRKLGLLAATLSDGPPVSLSVQVRGELASEDVEVLKLSALRVLFSAVVEGPVTFVNAPALAEERGVTAEISTASESPNHRSVVDVRAVSHDGTAVNVAGTLSGPQLVEKIVQINGRNFDLRARGINLVINYVDQPGALGKIGTLLGSAGVNIQAAQLSEDAEGPGATILLRLDQDVPADVRSAIGAAVGANKLEVVDLS

SEQ ID NO: 18783 - protein, 471 aa, Brucella suis 1330
MSFIPVIISGGSGSRLWPLSRDAHPKPFIKLPDGETLIGKTYARASRLVNAEQILTVTNRDFLFLTLDAYAAAGAAQMENTFLLEPLGRDTAPAVALAALHAAEAYGPDATLLVMPADHLIEDEQAFAEAVAKARALAEAGRIVTFGIVPDRPETGFGYIEVQGTDVQRFVEKPDEATAQTYVESGRYFWNSGMFCFKALSMIDAMQRYAPQVLAGARAALAQARRGNNGETKTLEIARDEFAATPAISIDYAVMEKADNMACVPVSCGWSDIGSWAAMADLVTPDENGNRLRGETILEDTTNSFVLSETRLVSLVGVHDLLVVDTPDALLVAHRDKAQEVRSVFNKLRKQGHEAAKLHRTAHRPWGTYTVLEEGDGFKIKRIEVKPGRRLSLQAHHHRSEHWIVVSGTAKVTNGDREILLTTNQSTYIPCGFRHRLENPGILPLVLIEVQSGEYLGEDDIVRYDDVYGRV

SEQ ID NO: 18784 - protein, 589 aa, Anabaena variabilis ATCC 29413
MQLRDSVRRTKIVATIGPATSSPEMLKAIIEAGATTLRLNFSHGSHADHQRSIRLIRQTAFELNQPVAILQDLQGPKIRLGKFENGSIVLAKGDRFTLTNRPVVGTQEISCVTYDYLADEVPVGAKILLDDGRVEMVVEDINRDKGDLHCRVTVAGKLSNNKGVNFPGVYLSIKAMTDKDREDLMFGLDQGVDWVALSFVRNPQDIIEIKELISSTGKQVPVVAKIEKHEAIEQMEAVLALCDGVMVARGDLGVELPAEDVPVLQKRLIATANRLGIPIITATQMLDSMVSNPRPTRAEVSDVANAILDGTDAVMLSNETAVGSYPVEAVATMARIAERIEQEEAMASKLRQMRDNRRSIPNAISQAVGQIAEQLGAAAIMTLTQTGATARNVSKFRPQTPILAVTPHVNVARQLQMVWGVKPLLVLELPSTGQTFQAAINVAQEHSLLFEGDLVVMTAGTLQGVSGSTDLIKVEVVTAVLGQGIGLGQGLVSGCARVAHTGMDVGNFNSGDILVAPRTGADFVEAIRKAGGIITEDESLTSHAAVIGLRLGVPVIVGVKKATQVIRDGAILTLDLQRGLVYSGAVGTP

SEQ ID NO: 18785 - protein, 338 aa, Ralstonia solanacearum
MKRINLTRYLIEEQREHNTIPAELRLLLEVVARACKAISHSVNKGALAGVLGSAGTGNVQGETQQKLDVIANEVLLEANEYGGNLAAMASEEMESFYEIPHRYPKGEYLLLFDPLDGSSNIDVNVSIGTIFSVLHMPKPGQTVTEADFMQPGVRQVAAGYAVYGPQTTLVLTVGNGVHMFTLDREVGSFILTNRDVKIPADTKEFAINMSNMRHWAPPVRRYIDECLAGTEGPRGKDFNMRWIASMVADVHRILTRGGIFMYPWDKREPGKAGKLRLMYEANPMAFLVEQAGGAATNGHQRILEIQPEKLHQRVAVILGSKNEVDRVTQYHREAQQTA

SEQ ID NO: 18786 - protein, 158 aa, Glycine max
  misc_feature (89)..(89): Xaa can be any naturally occurring amino acid
  unsure (1)..(158): unsure at all Xaa locations
KVVETALALQEAGCFSVVLECVPAPVAAATTATLQIPTIGIGAGPFCSGQVMTVLVYHDLLGMLQHPHHAKVTPKFCKQYARVGDVINXKALLGYKDDVINGSFPDAHHSPYKISKTDADVFSTELQRLGLDKAASAASEAVQKMDTTKSTSEGKQTK

SEQ ID NO: 18787 - protein, 347 aa, Escherichia coli CFT073
MELVRSKVMKSILIEKPNQLSIIEREIPTPSAGEVRVKVKLAGICGSDSHIYRGHNPFAKYPRVIGHEFFGVIDAVGEGVESARVGERVAVDPVVSCGHCYPCSIGKPNVCTTLAVLGVHADGGFSEYAVVPAKNAWKIPEAVADQYAVMIEPFTIAANVTGHGQPTENDTVLVYGAGPIGLTIVQVLKGVYNVKNVIVADRIDERLEKAKESGADWAINNSQTPLGESFAEKGIKPTLIIDAACHPSILKEAVTLASPAARIVLMGFSSEPSEVIQQGITGKELSIFSSRLNANKFPVVIDWLSKGLIKPEKLITHTFDFQHVADAISLFELDQKHCCKVLLTFSE

SEQ ID NO: 18788 - protein, 1032 aa, Avena sativa
MERARRLANRALLRRLLAGSASTTTPSPSRGISTLVPSPAAGSRPRRARPAHQHTPSRPVSVSALQPSDTFPRRHNSASPAEQTVMASTCGFNTLDSLIDATVPAAIRAPPMQFTGKFDAGFTESQMLEHMAHLASMNKVYKSFIGMGYYNTHIPAVILRNLMENPAWYTQYTPYQAEIAQGRLESLLNYQTMVADLTGLPMSNASLLDEATAAAEAMAMCNGILKAKKKTFLIASNCHPQTIDICQTRAAGFDLNVVVSDAKDFDYSSGDVCGVLVQYPGTEGEVLDYAEFVKDAHKHGVKVVMATDLLALTTLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPAGLKAIADRVHGLAGTFAHGLKKLGTVTVQELPYFDTVKITCADANAIAEEARKNEMNLRVVDANTITVAFDETTTLEDVDKLFKVFSGGKPVDFTAESIAPEVSSSIPSSLVRDSPYLTHPIFSMYHTEHELLRYLHKLQTKDLSLCHSMIPLGSCTMKLNATVEMMPVTDPKFANMHPFAPIDQAAGYHEMFDNLGELLNTITGFDSFSLQPNAGASGEYAGLMVIRAYHRARGDHHRNVCIIPVSAHGTNPASAAMCGMKIITVGTDSKGNINIPELKKAAEANKDNLSALMVTYPSTHGVYEEGIDEICRIIHDNGGQVYMDGANMNAQVGLTSPGFIGADVCHLNLHKTFCIPHGGGGPGMGPIGVKKHLAPFLPSHPVIPTGGFPLPEKTDPLGSISAAPWGSALILPISYTYIAMMGSQGLTDASKIAILNANYMAKRLEKHYPVLFRGVNGTVAHEFIIDLRGFKATAGIEPEDVAKRLMDYGFHGPTMSWPVPGTLMIEPTESESKAELDRFCDALISIREEIAQVENGIADVNNNVLKGAPHPPQLLMSDAWTKPYSREYAAFPAAWLRGAKFWPTTCRVDNVYGDRNLICTLQQASQVAEEAAAATA

SEQ ID NO: 18789 - protein, 265 aa, Idiomarina baltica OS145
MVAMTIAKLQKKKQQGEKIASLTAYDASFAKLMVEQGVDCILVGDSLGNVVQGRSSTVPVTMTDMVYHTECVRRGAPEAFIMSDLPFMSYGTLTDTLKNAAQLMQAGANMVKLEGGDWLVDSVKALTQRGIPVCAHLGLLPQSVNVLGGYRVQGKQEAQAVQLIEQARQLEAAGAQLLVLECIPNSLGKRVTEALTIPTIGIGAGPDTDGQILVMHDMLGMNSEYLPKFAKNFLEEGDGIAGAFRQFSEQVKSGDFPELKHSYEG

SEQ ID NO: 18790 - protein, 444 aa, Triticum aestivum
  misc_feature (340)..(340): Xaa can be any naturally occurring amino acid
  unsure (1)..(444): unsure at all Xaa locations
SWLHTIRSAAGSMVTYSRDRRGDDKDTSSEKGGRHSSSATEDSQDGVARHGPDRVKVRHNGKSYKELTGLFMNQQIHGHKGSIWSIKFSPDGRYLATAGEDCVIHIWEVLHSGMMKEEREVEDNGTCNPFAAMVCDESPEPMLASVATEGSHWEKRLPAKDLHSRRSGGSDQLMVPEHVFALSEKPVITFAGHLKDVLDLCWSKSQYLLSSSMDKTVRLWHMSSTYCLKAFSHSDYVTCIQFNPVDDRYFISGSLDEKVRIWSIPKREIVDWVDLHEMITAACYSPDGQSALIGSHKGNCHVYDTSDNMLSYKKQIDLQLKKKRSSQKKITGFQFLNSLXPGSSSKVIVTSADSRIRVVDGFELLHKFKGFQNTSSQISACSAANGRYIISASEDSRVYIWRYSDDSKPSRKKNIVPVTNTHENFRCERVTVAVAWACAGRQND

SEQ ID NO: 18791 - protein, 178 aa, Glycine max
MASSMISSPAVTTVNRAGAGMVAPFTGLKSMAGLPTRKTNNDITSIASNGGRVQCMQVWPPVGKKKFETLSYLPDLDDAQLAKEVEYLLRKGWIPCLEFELEHGFVYREHNRSLGYYDGRYWTMWKLPMFGCTDASQVLKELQEAKTAYPNGFIRIIGFDNVRQVQCISFIAYKPPSF

SEQ ID NO: 18792 - protein, 336 aa, Vibrio fischeri ES114
MSEIRTLGEFIVAKQHDFPHASGELSSLIGSIKLAAKIVNREINKAGLVDITGASGEENIQGEQQQKLDVYANDKFKSALEARDQVCGVASEEEDEAVAFNKELNKNAKYVVLMDPLDGSSNIDVNVSVGTIFSIYRRISPIGTPATEEDFLQPGHKQVAAGYIIYGSSTMLVYTTGNGVHGFTYDPSLGVFCLSHENMQIPKDGNIYSINEGNYIRFPEGIKQYLKFCQESKPEDNRPYTSRYIGSLVADFHRNLLKGGIYLYPSTQAYPNGKLRLLYECNPMAMLIEEAGGKATDGEQRILDIKPSELHQRVPFFVGSTNMVNKVHAFLDEWRD

SEQ ID NO: 18793 - protein, 147 aa, Arabidopsis thaliana
  misc_feature (114)..(114): Xaa can be any naturally occurring amino acid
  misc_feature (124)..(124): Xaa can be any naturally occurring amino acid
  misc_feature (135)..(135): Xaa can be any naturally occurring amino acid
  misc_feature (139)..(139): Xaa can be any naturally occurring amino acid
  unsure (1)..(147): unsure at all Xaa locations
MASSMFSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTXPGYYDGRYWXMWKFHCRMTRXGQVXNEFKRPGA

SEQ ID NO: 18794 - protein, 464 aa, Agrobacterium tumefaciens str. C58
MAKKSPPLDLSSTRGVSSWREAAQWLRVRGIEDIECITPDLAGVARGKMMPTAKFTGDTSLALPSALYRHTISGEYPDETANFRYEPRDSDLKLVPDLSTLSVVPWESDPTAQVICDVVDAEGNFVPYTPRNVLKNVLSLYTEKGWKPVVAPEIEFYLVAMNDDPDYPLHPPKGRSGRSIVGGQSYSIAGINEFDELIDDIYHFSEKQGLEIDTLIHEEGPAQLEINLRHGDPIELADQVFLFKRTIREAALKHGIYATFMAKPMQGQPGSAMHIHQSVVEIDGGRNIFSNADGSPSKVFFSFVGGMQRYVPNALVMLAPYVNSYRRLTPDMACPVNNAWGYDNRTTAFRVPISSPQARRVENRLPSSDANPYLALAASLGCGWLGIVNNIEPTEPTADTANEGSIELPRGLLEAVALLEGEEQFDRVFGHEFVGLYAGLKRGEFETFMQVISPWEREFLLLNV

SEQ ID NO: 18795 - protein, 260 aa, Antirrhinum hispanicum
MATVQKSQHSHFFLLVGCIVHLSNFCSTTTAQFDYFKLVLQWPNSYCSLKTTHCPRTRLPSQFTIHGLWPDNKSWPLSNCRDTSADVLKITDKGLIQDLAVHWPDLTRRQRKVPGQKFWVTQWKKHGACALPMYSFNDYFVKALELKKRNNVLDMLSRKSLTPGDQRVDVSDVNGAITKVTGGIAILKCPEGYLTEVIICFDPSGFPVIDCPGPFPCKDDPLEFPSSVKKKVPRSVSIGGSTLGLEKGASFSLTNTNTGY

SEQ ID NO: 18796 - protein, 475 aa, Shigella boydii
MLYFVNRYNMIKPIILAGGNGTRLWPLSRSQFPKQFLPLLDNKYSLFQQTLQRINCLQKLSPLIICNETHRFLVSQQLKDIDCNDANVLLEPIGKNTAPAIALAAFQYLKDSEDPLLLVLAADHYISDTGIFLESIKKAKKVAEQGNLITFGIVPDYPHTGYGYIERAKEVYDTVYEIRSFKEKPPYDRACEYIETGDYYWNSGMFMFRASVFLNELKKYEPSIYENCKHAIDSATVDSTFIRPEFHSFNKSPNISIDYAVMERTSIGMVISLDAGWSDVGSWSALCDINSKYHSSDNNNNNNVISIDSSNNFILSEDNLVATVGIKDLIIINTKDALLVADKNNDQNVKLVVEQIKKLGRNEHVEHPVNYRKWGRFEQIDEGVGFQVNRITIDVGKYISKQYHKYRAEHWIIVSGIAEITLDKVTKIYKENESVYVPTNCIHSIKNLGNTILEIIEVQSGTYFGEDDIIRLSTE

SEQ ID NO: 18797 - protein, 396 aa, Agrobacterium tumefaciens str. C58
MTEHNVRNFTINFGPEHPSAHGVLRLVLELDGEIVERVDPHIGLLHRGTEKLIETKTYLQAVPYFDRLDYVAPMNQEHAFALAVEKLLGLEIPMRGQLIRVLYSEIGRILSHIMNVTTQAMDVGAMTPPVWGFEEREKLMVFYERACGARMHSAYVRPGGVHQDLPPELVDDIGKWCDPFLTVLDNIEGLLTDNRIYKQRNVDIGVVSLEDAFAWGFTGVMVRGSGAAWDLRRSQPYECYSDLEFDIPVGKNGDCYDRYLIRMQEMRESVKIMKQCVDRLSGKHRIGPVSSLDGKVVPPKRGEMKRSMEALIHHFKLYTEGYHVPAGEVYAAVEAPKGEFGVYVVADGSNKPYRCKIRAPGYAHLQAMDFLCKGHQLADVTAVLGSLDIVFGEVDR

SEQ ID NO: 18798 - protein, 264 aa, Candidatus Pelagibacter ubique HTCC1002
MFFNLFIIILFILFILFILSVIRIYQMAHLILVRHGQSEWNLEKRFTGWVDVDLTGQGKLEACKAGENIKETKIDIDYFYSSFQLRAINTLKFIQDTLRDKREPVKAWQLNERHYGALTGLNKDEMKEKLGEDKIHAFRRSWDIKPNPLSRNNPYHPLNIEVYKSIPKENIPDTESLKDTYDRVMKFYIDEIQMKLKNDKNILISAHGNSIRALCKFLFKLDNQRITLLEIPTGNPLLINLDSKQNIKECTYLNQDRAKDLLVF

SEQ ID NO: 18799 - protein, 605 aa, Oryza sativa
  misc_feature (8)..(8): Xaa can be any naturally occurring amino acid
  misc_feature (25)..(25): Xaa can be any naturally occurring amino acid
  unsure (1)..(605): unsure at all Xaa locations
GGGGGGGXRKDRGEGLGRALTRQRXNKAAAAAKERGHALALARRARQPLESVIEVSDIDAVLQRAAEEYLLLGGGGGDGAGDVALSASLGSGLIDLDGTVETEEERRWLREEQEALHAGSLKVPRRPPWTPQMTVEELDANEKRAFLEWRRNLARLEENEKLVLTPFEKNIDIWRQLWRVLERSDLLVMVVDARDPLFYRCPDLEVYAQEIDEHKRTLLLVNKADLLPLNVRQRWAEYFKQHDILYLFWSAKAATADLEGKKLSSYSMENWNTADLDTKIYGRDELLVRLQGEAEYIVNQKGALRAEEGHESSRSDSVSTRPKHVVVGFVGYPNVGKSSTINALVGQKRTGVTSTPGKTKHFQTLVISEELILCDCPGLVFPSFSSSRHEMVACGVLPIDRMTKHRGAIQVVANRVPRNVLEQIYKITLPKPKAYEQLSRPPTAAELLRAYCTSRGHVSHAGLPDETRAARQILKDYLDGKIPHFELPPGDTDSETDPEETTDLEGSDTAVGATADHCASDEQDEEISQADPNISHVLSDLESFDLASEVSKNSTKKKKEASYKHHKKPQRKKDRSWRVGNDGADGSAVVRVFQKPAVNFATVTG

SEQ ID NO: 18800 - protein, 814 aa, Pseudomonas aeruginosa
MRALNPDVLVVQKRPEGVLPLDELVRRIEGAEPGRKVAFVWVEMDSDKAGRIFYTPPPGQRRGESRWIDPYTGAFVGEPRGEGFFNLMMQLHRFLAMGEYGKQVTAACTLILIFFCLSGLYLRWPRKVFDWRAWLTLDWSRKGRSFNWDLHAVAGTWCLALYLLAALTGLYWSYEWYRNGLFKLLDDAPAGQQAQRGKPGGRGERPADAAPLVVDYAAVWNSIRQAGGDRLQAYNLRLPPAGGQPATVFYRLTDAPHERAFNTLTLDPANGQVKSDQRYSDRSFGSQLLASVYALHVGSYFGMAGRILMMLASLAMPLFFITGWLLYLDRRRKKRAVRASRADLGGSAGASGEPWLIGYASQSGFAEQLAWQSAGQLQAAGLPVRVESLARLDAGQLAEARKALFVVSTFGDGEAPDSARGFERKVLGQAASLDGLSYALLALGDRQYEQFCGFARRMQGWLQGQGARSLFAPVEVDDGDAAALRQWQESLAEVTGGAAPAAWEAPAFEVWSLARRECLNPGSQGESTWLLDLRAPANSAIQWRAGDLLEIVPHQAPVRIREWLQRHNLDGQARVAVEGVEQSLEQALAGRLLPDSFEHLVGLHPQALLDALIPLSVRQYSIASLQSDGDLQLIVRQEQHADGSLGICSGWLTEYLPLGAALTLRLRRNAGFHLPEDDVPLILIGNGTGLAGLRSLLRASIAAGRKRNWLLFGERNFAHDYYCRAELEQALARGELQRLDLAFSRDQAEKIYVQDRLHEAADELRRWIDEGAALYVCGSLQGMAGGVDRVLREVLGEEALQRLADEGRYRRDVY

SEQ ID NO: 18801 - protein, 260 aa, Burkholderia thailandensis E264
MTVPKLQAMREAGEKIAMLTCYDASFAALLDRANVDVQLIGDSLGNVLQGQTTTLPVTLDDIAYHTACVARAQPRALIVADLPFGTYGTPADAFASAVKLMRAGAQMVKFEGGEWLAETVRFLVERAVPVCAHVGLTPQSVHAFGGFKVQGKTEAGAAQLLRDARAVEEAGAQLIVLEAVPTLVAAEVTRELSIPTIGIGAGAECSGQVLVLHDMLGVFPGKRPRFVKDFMQGQPSIFAAVEAYVRAVKDGSFPGPEHSF

SEQ ID NO: 18802 - protein, 286 aa, Saccharomyces cerevisiae
MSNAEASRVYEIIVQSVVNEVREDFENAGIDEQTLQDLKNIWQKKLTETKVTTFSWDNQFNEGNINGVQNDLNFNLATPGVNSSEFNIKEENTGNEGLILPNINSNNNIPHSGETNINTNTVEATNNSGATLNTNTSGNTNADVTSQPKIEVKPEIELTINNANITTVENIDDESEKKDDEEKEEDVEKTRKEKEQIEQVKLQAKKEKRSALLDTDEVGSELDDSDDDYLISEGEEDGPDENLMLCLYDKVTRTKARWKCSLKDGVVTINRNDYTFQKAQVEAEWV

SEQ ID NO: 18803 - protein, 324 aa, Idiomarina baltica OS145
MKRLLPTLRADNAPEGLISVLNTIQIAAKEISFRLHQGALAGVLGSTLDENIQGETQKKLDVVANQLLKTLLLESPRVHAIASEEEDSIVLSPNSGEYLVAFDPLDGSSNIDINGTVGTIFSVLPKPENSANDESMFLQKGRNQVAAGYVLYGPSTMLVMTTGSHVRTYTLDQTVGEFLLTKDTASIPADTQEFAINMSNQRHWGTAVREYVEHLLLGEDGPRQKNFNMRWNAAMVSDVHRLVTRGGLFTYPWDARNPDKPYKLRLMYEAAPMAMIVEKAGGSASNGYVPILDIEPEQIHQRVAVVMGSTNEVQKCVEYHEKHG

SEQ ID NO: 18804 - protein, 923 aa, Oryza sativa (indica cultivar-group)
MTTNTKRAYKLRILANSFPVFLTSIFCIFFREEFVAHSSNVNCLKIGRKTSRVLVTGGDDHKVNLWAIGKPNSILSLSGHTSAVESVNFDSTEVFVAAGAASGTIKLWDLEEAKIVRTLTGHRSNCMSVDFHPFGEFFASGSLDTNLKIWDIRRKGCIHTYKGHTRGVNAIRFTPDGRWVVSGGEDNVVKLWDLTAGKLLHDFKCHEGQIQCIDFHPHEFLLATGSSDKTVKFWDLETFELIGSTGPETTGVRSMTFNPDGRSLLCGLHESLKVFSWEPIRCHDTVDVGWSRLSDLNVHEGKLLGCSFNQSCVGIWVVDLTRLEPYATGTSTKLNGHSELKSSSSSTMPLQNDSGSRANIGRLSVLQNSENNIKSSTGRLSVSQNSDSALKETKSTTSSGLVPVTPQRAGNGSSTKTVGNSTFASSGTNLKRGSLKSNNSSSLQNFSKIDVVPVIIPRTSSGPELATDSRSDAADVGPVLSKSGRRIEIANDSRKESSDVAAAVVPRTNSRTEMASDSAPVVGPRANLRMEVSADSAPIVPKSGRRLESSVESRKESTDVASAAAPKTSSRMEVAPDSAPLLSKAGRRVESATDSRKESADVAPVVPRTTSRMEMAPDSRREISAGRMSPFRVQSRYSELRKLNNAKADADKVDAGSKNSEADDFTCQIYLPRRNGVVQSGISEETREDAKPGVIDRMGFPSSAEPNTHRNVSRMRKPRDNCYIEVSRAALAYTWKRGSSQAAETPTISSDEDVLSVLMEQHELFLSSTRSRLTKLQIVHQMWQRNDIRGIIAAMEKMSDHAVSADVASVLMEKSETITLDLCTVILPVLTDLLESKTDRHLGVSLELLVKLVRTFGSVIHSTVSAGPSSVGVDLQAEQRRERCNLCFIELEKVKNKLPFLSRRKGAVANTAQELSLVFQEVM

SEQ ID NO: 18805 - protein, 474 aa, Oryza sativa
MNLAGFLATPATATATRHEMPLNPSSSASFLLSSLRRSLVASLRKASPAAAAALSPMASASTVAAENGAAKAAAEKQQQQPVQSTLGPGVTVAKRLEKFKTTIFTQMSMLAIKHGAINLGQGFPNFDGPDFVKEAAIQAINAGKNQYARGYGVPELNSAIAERFLKDSGLQVDPEKEVTVTSGCTEAIAATILGLINPGDEVILFAPFYDSYEATLSMAGANVKAITLRPPDFSVPLEELKAAVSKNTRAIMINTPHNPTGKMFTREELEFIATLCKENDVLLFADEVYDKLAFEADHISMASIPGMYERTVTMNSLGKTFSLTGWKIGWAIAPPHLTWGVRQAHSFLTFATCTPMQAAAAAALRAPDSYYEELRRDYGAKKALLVNGLKDAGFIVYPSSGTYFVMVDHTPFGFDNDIEFCEYLIREVGVVAIPPSVFYLNPEDGKNLVRFTFCKDDETLRAAVERMKTKLRKK

SEQ ID NO: 18806 - protein, 404 aa, Photorhabdus luminescens subsp. laumondii TTO1
MLAVKKSSKLDNVCYDIRGPVLKEAKRLEEEGNKVLKLNIGNPAPFGFEAPDEILVDVIRNLPTAQGYSDSKGLYSARKAIMQHYQARNMMDVTVEDIYIGNGVSELIVQAMQALLNTGDEMLVPAPDYPLWTAAVSLSSGKAVHYMCDEGSDWFPDLNDIRNKITPRTRGIVIINPNNPTGAVYSKELLLEVVEIARQHNLIIFADEIYDKILYDDAEHHSIAALAPDLLTVTFNGLSKTYRVAGFRQGWMVLNGPKKHAKSYIEGLEMLASMRLCANVPMQHAIQTALGGYQSISEFILPGGRLYEQRNRAWELINQIPGVSCVKPKGALYMFPKIDAKRFNVHDDQKMVLDLLLQEKVLLVQGTAFNWPEPDHLRIVTLPRLDELEMAIQKFARFIGKYHQ

SEQ ID NO: 18807 - protein, 479 aa, Rubrivivax gelatinosus PM1
MVTEYRNYIDGEFLANRSGALIDVHNPATHELLARVPDAPNDVVDLAVQAARTAQPGWAKLPAIQRAQHLRAIAARLRENVEELAHTITAEQGKVLGLARVEVNFTADYMDYMAEWARRLEGEVLTSDRVGESIFLMRKPIGVAAGILPWNFPFFLIARKLAPALITGNTIVIKPSEITPINAFEFARLASQTDLPRGVFNLVGGTGAGAGAQLTSHRDVGIVSFTGSVETGTRIMTAASKNLTRVNLELGGKAPAIVLADADLDLAVKAIYDSRVINTGQVCNCAERVYVQRKVADEFTSKIAARMAGTLYGDPLAQPDVAMGPLVSQAGLDKVAGMVDRARAAGASIVQGGRKANRDKGYHYEPTVIANCSADMEIMRKEIFGPVLPIQVVDELDEAIALANDSDYGLTSSIFTKDLNSAMRAVRDLQFGETYVNREHFEAMQGFHAGRKKSGIGGADGKHGLYEFTETHVVYIQHG

SEQ ID NO: 18808 - protein, 308 aa, Streptomyces avermitilis MA-4680
MADWNTSDIPDQRGRVVVVTGANSGLGYVTARELARKGARVVLACRSEARGAEAGDRLAAELPGAEVELGRLDLGDLGSVRDFAAWFPYERLDLLVNNAGVMALPYGTTADGFETQFGVNHLGHFALTGLLLPTLLGTPGARVVTVSSGMHALANIDIHDLNGERRYRRWIAYARSKTANLLFTHELTRRLAAHGSEVLAAAAHPGYAATNLQTAGVRMEGRRAAERIVELGNRVLAQPAEAGALPVLYAATAPEVRPDSFTGPSFAGWRGAPAPSWRAPWTLNDAMGERLWSASEQLTGVTYEALKV

SEQ ID NO: 18809 - protein, 144 aa, Glycine max
  misc_feature (44)..(44): Xaa can be any naturally occurring amino acid
  misc_feature (60)..(60): Xaa can be any naturally occurring amino acid
  misc_feature (89)..(89): Xaa can be any naturally occurring amino acid
  unsure (1)..(144): unsure at all Xaa locations
DSPKRQQLNGNEINERYRGSPDDLILNHKTGKSLGDIIPCSDEXYSECVQKSGRITTGIXVLIRNKSKKNGDMNEAIYSLYFDDYGNIXAHGTYLTYEDTYLDVTGGSGINEEDDDIIELDASEIPFKLLYTSYLNGHGDLPQE

SEQ ID NO: 18810 - protein, 332 aa, Triticum aestivum
MSAANRSQPIKLNRPVVGKARKLKDLMLKSDNRVCADCSAPDPKWASSNIGVFLCLKCGDVHRALGQDISNVLSLTLDDWSDSDIDSMIEVGGNSYANSIYEAFLPKDHPKPKPDSPMEYRTKFIRAKYETQDFLKPSLRISSKAGLESTNSLNSVDNSFSSTSRKHAPEDTREFVGQLNVTVVKGSGLAVRDMLTSDPYVVLSLGEQKAQTTVKASDLNPVWNEVLNLSVPRNYGPLKLEVYDHDTFSADDIMGEAEIDLKPMITAAMAFGDPSRHADMQIGRWFMTRDNCLLSDSIVNISSGKVKQEVYLKLQNVESGEMELELEWARLD

SEQ ID NO: 18811 - protein, 151 aa, Glycine max
MKPIDDKQETVTIRAVSHDEEGRKRVEKIELNTHNIHTIKYVEKKLINKGVQRKDRHPADGIRIGRPPPKSGHGGKFTWEGPASVEDNELMTEPAAMDEGDPNYLDWEERGEETSELVVGEVEVAKVAEEHDGVARVEVDPRLRVIMSDLC

SEQ ID NO: 18812 - protein, 957 aa, Escherichia coli O157:H7 EDL933
  misc_feature (84)..(84): Xaa can be any naturally occurring amino acid
  misc_feature (151)..(151): Xaa can be any naturally occurring amino acid
  misc_feature (472)..(472): Xaa can be any naturally occurring amino acid
  misc_feature (787)..(787): Xaa can be any naturally occurring amino acid
  unsure (1)..(957): unsure at all Xaa locations
MTQTLSQLENSGAFIERHIGPDAAQQQEMLNAVGAQSLNALTGQIVPKDIQLATPPQVGAPATEYAALAELKAIASRNKRFTSXIGMGYTAVQLPPVILRNMLENPGWYTAYTPYQPEVSQGRLEALLNFQQVTLDLTGLDMASASLLDEXTAAAEAMAMAKRVSKLKNANRFFVASDVHPQTLDVVRTRAETFGFEVIVDDAQKVLDHQDIFGVLLQQVGTTGEIHDYTALISELKSRKIVVSVAADIMALVLLTAPGKQGADIVFGSAQRFGVPMGYGGPHAAFFAAKDEYKRSMPGRIIGVSKDAAGNTALRMAMQTREQHIRREKANSNICTSQVLLANIASLYAVYHGPIGLKRIANRIHRLTDILAAGLQQKGLKLRHAHYFDTLCVEVADKAGVLARAEAAEINLRSDILNAVGITLDETTTRENVMQLFSVLLGDNHGLDIDTLDKDVAHDSRSIQPAMLRDDXILTHPVFNRYHSETEMMRYMHSLERKDLALNQAMIPLGSCTMKLNAAAEMIPITWPEFAELHPFCPPEQAEGYQQMIAQLADWLVKLTGYDAVCMQPNSGAQGEYAGLLAIRHYHESRNEGHRDICLIPASAHGTNPASAHMAGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKKASQVAIXNANYIASRLQDAFPVLYTGRDGRVAHECILDIRPLKEETGISELDIAKRLIDYGFHAPTMSFPVAGTLMVEPTESESKVELDRFIDAMLAIRAEIDQVKAGVWPLEDNPLVNAPHIQSELVAEWAHPYSREVAVFPAGVADKYWPTVKRLDDVYGDRNLFCSCVPISEYQ

SEQ ID NO: 18813 - protein, 356 aa, Kluyveromyces lactis NRRL Y-1140
MPDMTNESSSKPAQINIGINGFGRIGRLVLRAALTHPEVKVRLINNPSTTPEYAAYLFKYDSTHGKYRGEVEFDDERIIIQNDHVSAHIPLSHFREPERIPWASYNVDYVIDSTGVFKEVDTASRHKGVKKVIITAPSKTAPMYVYGVNHVKYNPLTDHVVSNASCTTNCLAPLVKALDDEFGIEEALMTTIHATTASQKTVDGTSSGGKDWRGGRSCQGNIIPSSTGAAKAVGKILPELNGKITGMSIRVPTINISLVDLTFRTAKKTSYDDIMKALEQRSRSDMKGVLGVTKDAVVSSDFTSDSRSSIVDAKAGIELNDHFFKVLSWYDNEYGYSSRVVDLSIFMAQKDFEAGV

SEQ ID NO: 18814 - protein, 468 aa, Silicibacter pomeroyi DSS-3
MSKDAVLQLIKDEGAEYVDIRFTDPRGKLQHVTIVSDLVDEDFLEEGFMFDGSSIAGWKSIEASDMKLMPDTESAYVDPFYAEKTICIHCSVVEPDTGEAYDRDPRGTAVKAEAYLKASGIGDVAYMGPEAEFFLFDDVRFSNTINKVSYEVDATDASWNSDAEFETGNMGHRPGLKGGYFPVNPIDEAQDLRAEMLSTMKRMGMKVDKHHHEVASCQHELGLIFGTLTKQADEIQKYKYVIHNVAHAYGKSATFMPKPIYGDNGSGMHVNMSIWKDGKPLFAGDKYADLSQEALYFIGGILKHAKTLNAFTNPGTNSYKRLIPGFEAPVLRAYSARNRSGCVRIPWTESPKAKRVEARFPDPSANPYLCFAALLMAGLDGIKNKIDPGEAMDKNLYDLPAEELADIPTVCGSLREALECLASDHDFLLQGDVFTKDQIEGYIELKMEEVHKYEHTPHPVEFGMYYSC

SEQ ID NO: 18815 - protein, 69 aa, Medicago truncatula
MTEAPFRAMDEFDVFMDPVSRKISMDTLIDFAEAQGSQWILITPNDTSLVKGGNRVKKMQMAAPRAYQM

SEQ ID NO: 18816 - protein, 478 aa, Shigella boydii
MSNNIICPVIMAGGSGSRLWPLSRLFYPKQFLKLVDDSSMLQETISRLGDLPCSLPVVICNEQHRFIVAEQLRMINKLTNNIILEPVGRNTAPAIALAAMISESFSSLEDPLLLVLAADHDIKNHKSFRDAVRKAIPFAEQGKLVTFGIVPSMAETGYGYIKRGHEISLENDEVAYTVSKFYEKPNISDAQKFLASGKFYWNSGMFLFRASRYLSELNKFRPDIYLACASSTKNINTDLDFIRVDENSFSNCPDESIDYAVMEQTSDAVVVPMNAGWSDVGSWSSLWEISKKNEQGNVNHGDVINHNTENSYVYAESGLVTTIGVKDLVVVQTKDAVLVADRNSVQDVKKVVEQIKAHGRSEHQMHREVYRPWGKYDSIDAGERYQVKRITVKPGEGLSVQMHYHRSEHWVVVAGTAKVTIDGVIKLLGENESLYIPQGAKHCLENPGKIPLELIEVRSGSYLEEDDVVRFADRYGRV

SEQ ID NO: 18817 - protein, 236 aa, Medicago truncatula
MTVPLIFYAKAFMLTIFTTTQAEESDMEEKLKGLREEVDAAEFELKRLKKEEDILMTNIDKQKEEISSIAAKITAFGGNKVLSLLRIIERCHQRFRMPPIGPIGAHLKLHNGNKWAVAVEYAIGRLFNSFIVTDHKDFRLLKQCAKEADYGQLKIIIYDFSTPRLMIPERMRPNTNHPSILSILQCENDTVLNVLVDQGNVERQVLVNDYGIGKVIAFEKRIQNLKEVFTVEGYKM

SEQ ID NO: 18818 - protein, 475 aa, Fusobacterium nucleatum subsp. nucleatum ATCC 25586
MRSLKKTKIVCTIGPVTESVETLKELLNRGMNVMRLNFSHGDYEEHGMRMKNFRQAMSETGIRGGILLDTKGPEIRTMTLKDGKDVSIKAGQKFTFTTDQSVVGDNERVAVTYENFAKDLKVGNMVLVDDGLLELDVVEIKGNEVICIARNNGDLGQKKGINLPNVSVNLPALSEKDIEDLKFGCQNNVDFVAASFIRKADDVRQVRKVLRENDGERIQIISKIESQEGLDNFDEILAESDGIMVARGDLGVEIPVEEVPCAQKMMIRKCNRVGKTVITATQMLDSMIKNPRPTRAEANDVANAILDGTDAVMLSGETAKGKYPLAAVEVMNKIAKKVDATIPPFYIEGVINKNDITSAVAEGSADISERLNAKLIVVGTESGRAARDMRRYFPRAHILAITNNEKTANQLVLSRGIISYVDASPKTLEEFFVVAESVAKKLNLVKNNDIIIATCGESVFIQGTTNSIKVIQVKA

SEQ ID NO: 18819 - protein, 164 aa, Medicago truncatula
MKRARSTYESSSSRVSPSLEAGIIKKLRLENFMCHSNHETQFGSNVNLITGQNGSGKSAILTALCVAFGCRAKGTQRASTLKDFIKTGSSNAVIHVEIQNEGEDAFKPEIYGDVIIVERRISESSSSITLKDQQGKKVFSRKADLQEIVEHFNVGFLYPTSLLL

SEQ ID NO: 18820 - protein, 256 aa, Agrobacterium tumefaciens str. C58
MSSTHKHTGRMSIDDFRHEAMAETPSTNLECFARARAGDGGNLWVTAIRQTGGRGRRGRPWVSEPGNLYASLLLIDPAPVERIGSLPLAFALAVYRAIRAVLPTAGEPLEIKWPNDVLIGRRKTCGILMEAELLPDGRRAIVIGIGINIAHKPDNPLYPVTMLSEHGASCSPDELFAHLFRETAEVLRNWDEGRGVSGIMTGWRAAACGIGEHITVNFPDRSIGGRFVGIDDNGYLLLDEDEGARRSIAAGDVFFG

SEQ ID NO: 18821 - protein, 577 aa, Prochlorococcus marinus subsp. pastoris str. CCMP1986
MKETSPKSNNGTIVDNNENFNIEFDPISDALAAIRNGECIIVVDDERRENEGDLICAAQFATPQQINFMATEGRGLICLAMQGEKLDALDLPLMVDRNTDENQTAFTISIDAGPENNVTTGISAEDRAKTIQVAINPSTKPEDLRRPGHIFPLRAKKGGVLKRAGHTEAAVDIAAMSGLYPAGVICEIQNPDGSMSRLPQLKQYAKEWGMKLISIADLISYRFQNERFVYRKSDAILPSIFGNFKAYGYINELDGSEHIALVKQKSNKLSEPVLVRMHSECLTGDAFGSLRCDCRPQLEAALARIEKEEEGVVVYLRQEGRGIGLINKLKAYSLQDGGLDTVEANEKLGFPADLRNYGVGAQILTDLGIKKLKLLTNNPRKIAGLGGYGIEVTERVPLVICPGEHNSEYLNVKRQKLGHMLEEEKLNSIDIDPYIAIFLDGDYKSIDLVPIKNKIIEFCEKNKINIMLESSPRLLAFWNRPKLVWKILHDKNREDFTINDNEINKIEIFIKFLSEYNKSSKVGIIVSKNIQQALHPKNSIKLKNTKFSIKNEELHSSTRKFNLDKETFSIIFDKKLS

SEQ ID NO: 18822 - protein, 785 aa, Oryza sativa (indica cultivar-group)
MPEAAAAAAGHMDPVGDEAAERREMEEKEEEEEEDEEFYESLDRILSSSCSSTSASDDDDQQHRRRRRHHPQPQQLSSSATFSAYEVWISEPTSVEERRRVLLRRLGLAHDSEPLPHPSPRVSSSSPRSPTPSPPSSSPPRPAPVVAAAEEPRSSGHGKPPLARNPSGGAEQCRIRNLDDGTEFEVGEVHDEVVREVGTGRQLTFEEFELCIGRSPIVQELMRRATTAASSSTSDQAAPASKPRRKPGGWLRGIRHLAGSVAYGRSSTDERDKEKEKEKKEREARRLSSATDDSLDGNGSRNAGRVRVRQYGKACKELTGLFMTQELAAHSGSIWCINFSLDGRYLASAGEDRVIHVWEVSEGERKGELLGEGTVARENGGGCSPFLAAVGNGSPELATLSLSCADGGFVEKKRRPRMQSSRKSVGSDHLVVPECVFGFRDKPVCSLLGHAADVLDLSWSKSQYLLSSSMDKTVKLWDITTSTCLKTFSHTDYVTCIQFNPVDDNFFISGSLDEKVALVGSHKGSCHLFDTTEKKLQYKSQIELRIRKKKSGQKKITGFQFAPGSSSEVLITSADSRIRVVNGDELVHKFKGFRNTSSQISASVAPNGKYVVCASEDSHVYVWRHDNTSHPSRSRSAVDVTNSYEHFHCHDVTVAITWPGAESRGSFGSRSSRNSDSDDAVMNTGRDAPVENSEHDLNGTVNRCTKRPVCEGVASTSNPPADGVSTSWPDEKQSSAKSSPGHCSSDLCIGALDVQRRSAWGLVIVTAGRGGEIRVFQNFGFPVQV

SEQ ID NO: 18823 - protein, 219 aa, Francisella tularensis
MNGNSTSIKELCSGISQVQYDTSRVAIAVFPSSVYVKEVISQLPEKVGVGLQNITFYDDGAYTGEISARMLEDIGCDYLLIGHSERRSLFAESDEDVFKKLNKIIDTTITPVVCIGESLDDRKSGKLKQVLATQLSLILENLSVEQLAKVVIAYEPVWAIGTGVVASLEQIQETHQFIRSLLAKVDERLAKNIKIVYGGSLKAENAKDILSLPDVDGGL

SEQ ID NO: 18824 - protein, 379 aa, Yersinia pestis biovar Medievalis str. 91001
MEMIKTRAAVAWGPNQPLSVEEVDLMPPQKGEVLVRIVASGVCHTDAYTLSGADPEGVFPTILGHEGGGIVEAIGEGVTSVAVGDHVIPLYTPECGECKYCRSGKTNLCQAIRSTQGKGLMPDGTTRFSKNGQPIFHYMGTSTFSELTVVPEISLAKINKEAPLEEVCLLGCGVTTGMGAVMNTAKVKPGDTVAIFGLGGIGLSAVIGAQMAGASRIIGIDLNTSKFELARKLGATDLINPKDYDKPIQEVIVELTDGGVDFSFECIGNVNVMRSALECCHKGWGESVIIGVAGAGEEISTRPFQLVTGRVWRGSAFGGVKGRSELPGIVQQYLDGKFALNDFITHTMALDQINEAFDLMHEGKSIRSVIHFNHSSESK

SEQ ID NO: 18825 - protein, 138 aa, Glycine max
  misc_feature (113)..(113): Xaa can be any naturally occurring amino acid
  unsure (1)..(138): unsure at all Xaa locations
MESIAAQLKRGISRQFSSGSLRRNLSRQFTRQASLDPRRNNQRFSIGRQSSLDPIRRSPGPVQPELTVPENLDSTMQLLFMACRGDAKGVDDLLNEGIDVDSIDLDGRTVLHXAGCEGHGEVARLLLTRKADLDARDR

SEQ ID NO: 18826 - protein, 274 aa, Photorhabdus luminescens subsp. laumondii TTO1
MTMQTSSSSAGTGFYERAFGSFSAEAVSEVRKETYGEDLGQNNWSSADEFRKFSQWLQLSDSSHVLDVCSGSGGPALFLARTSGCSVTGVDIHPHGLLTARQLAADFGLEDRSNFVDSDVRQPLPFPDGTFDALWCIDSVIHIPDRLALLREWCRLLKPGGRFLYTDPTLVTGMLSKDEIMIRGMPGYFLYSPLGLNERLISEAGLCLERQVDLTQSVVELSERWRAGREKRREQFIAIEGEEAFERMQNFLSTTQLVSIERRLSRVAFIGYRP

SEQ ID NO: 18827 - protein, 376 aa, Xanthomonas campestris pv. campestris str. ATCC 33913
MNFAPVPELIEELRAGRMVVIVDDEDRENEGDLIMAAELVKPSDINFMVTHARGLVCLSLTRERCTQLGLAPMVRNNTAQFHTNFTVSIEAAEGVTTGISAYDRAHTVRTAVRPDAKPHDLSQPGHIFPLIAQPGGVLTRAGHTEAASDLPMLAGLEPAGVLVEVLNPDGSMARRPQLEVFAREHGLKMGSIADLIAYRLANEHTVERVDEREIETEFGPFHLVTYRDRIAHDLHFALVRGTPDPTTPTLVRVQVENPLADLLHWQRDDFGVAATDALRAIAAEGQGVMVVLSAPRDSESLLARLRQQPEVAANAKDVSQWRRNGAGAQILADLGLGKLRVLGTPRRQVGLAGFGLEVVEFLECHPGAASRVAAAP

SEQ ID NO: 18828 - protein, 189 aa, Cucumis sativus
MASSILSSAAVASVNSASPAQASMVAPFTGLKSSAGFPITRKNNVDITTLASNAGKVQCMKVWPPLGLRKFETLSYLPDMSNEQLSKECDYLLRNGWVPCVEFDIGSGFVYRENHRSPGFYDGRYWTMWKLPMFGCTDSSQVIQEIEEAKKEYPDAFIRVIGFDNVRQVQCISFIAYKPQVLLFLSSIC

SEQ ID NO: 18829 - protein, 292 aa, Kluyveromyces lactis NRRL Y-1140
METKDVLEAVKGLEKNKNNNDVVFKILQSLDKDLKDVNEKLLRETKVGVVVNQFKKSSNPDIVKLVKKMILSWKDAVAREKKSKLSSNSSSTSNNNGTSGGEAVKKEKYVSKAPRNAKNDGVKTDIYGVKIRDMAIRALYDALAKESEHPPVAILDTVMSIETEMANLFNPESDEKGYRDKYRIIYSNIISKNNPDLKHRITNGEVSAKHLVTADPKDLAPEHLKKKIEEIEKQNLFNAQGATVERSVTDRFQCGKCKQRKVSYYQLQTRSADEPLTTFCTCENCGNRWKFS

SEQ ID NO: 18830 - protein, 272 aa, Vibrio fischeri ES114
MSTRNDVHLGHKARKRFGQNFLNDPYVIDGIVSAINPLPGQNLVEIGPGLGAITEPVGREVDKFTVIELDRDLAERLRNHPELGSKLTIHEGDAMRFDFTQLIKENNKLRIFGNLPYNISTPLMFHLFEFHKDVQDMHFMLQKEVVNRLAAGPGTKAYGRLTVMAQYFCKVMPVLEVPPTAFVPPPKVDSAVVRLVPYETLPYPATNLKWLDRVCREGFNQRRKTVRNCYKALLTKEQLEELGINPSMRPENLTLEQFVNMANWLDANHSAE

SEQ ID NO: 18831 - protein, 253 aa, Borrelia garinii PBi
MRKTFLAGNWKMHYTSTEASIVAKKIATEVKTLKDDFVIMITPPFTALSKVSECIKGSNILLGAQNMSYMESGARTSEISPSMLLEFGVEYVILGHSECRLYLGETDEIINKKILTGLKHPFKYLILCVGETLNERDSEKTLDVVLNQVKKGLDGVSESDIKRIILAYEPIWAIGTGKTATKEEAEEVHKAIRLEIMKLYSKSVSDNVIIQYGGSVNSSNVKELMNEPDIDGALIGGASLKAESFLSIINNVL

SEQ ID NO: 18832 - protein, 120 aa, Triticum aestivum
  misc_feature (21)..(21): Xaa can be any naturally occurring amino acid
  misc_feature (52)..(52): Xaa can be any naturally occurring amino acid
  misc_feature (60)..(60): Xaa can be any naturally occurring amino acid
  unsure (1)..(120): unsure at all Xaa locations
MAPAVMASSATTVAPFQGLKXTAGLPVSRRSGSAGLSSVSNGGRIRCMQVWXPIEGIKKXFETLSYLPPLSTEGPPKKGAPSGVTWPPSKVEFPPKPGTGSDWGKLSAPASARRFMPAHF

SEQ ID NO: 18833 - protein, 479 aa, Sphingomonas sp. tfd44
MTYPDTRLFIGGRWQDAADGRSLAVQNPATGLEIGRVAHCGRADLDRALDAAQRGFEIWRDLTPAERSKIMRRAAGLMRERADEIARLLTQEQGKPLHEAKIEAMAAGDIIEWFAEEGFRLYGRLVPHRTDIAIRQMVIKDAVGPVAAFTPWNFPINQVVRKISAALAAGCSMIVKAPEETPASPAELIRAFQDAGLPDGVLNLVFGDPAEISNYLISSPIIRKITFTGSTPVGKLLASLAGKHMKRVSMELGGHAPAIVCEDADIGLAVKSLSASKFRNAGQVCIAPTRFLVHSSIKHAFADALAAAARDLRVGDGFADGTQIGPLANSRRLAAMAEFQQDAIEKGATLLTGGNRVGDVGNFWAPTVLSDVPLEARLFNDEPFGPVAGIRSFDRLEEAILEANRLSFGLAGYAFTKSLATADILARRVEVGMLWVNSPATPTAELPFGGIKDSGYGTEGGPEALDNYINPRAVVVANV

SEQ ID NO: 18834 - protein, 398 aa, Burkholderia xenovorans LB400
MNSVTEPLVRLAARVDAIQPFYVMELAKEAALLERDGRDIIHMGIGEPDFTAPEPVIEAAASALRRGVTQYTNALGLHALREAISAHYADFYGVSVDPARIVVTAGASAALLLACAALVDRDDEVLMPDPCYPCNRHFVIAAEGKPVMVPSGPAERFQLTAADVERLWNERTRGVLLASPSNPTGTSIEPAELERIVKAVRARGGFTIVDEIYQGLSYDAKPISALSFGDDVITVNSFSKYFNMTGWRLGWLVVPPGMVSAFEKLAQNLFICASALAQHAALACFEPDTIAIYEARRLEFKRRRDFIAPALQSLGFSVPLMPDGAFYVYADCRTVAHPAAGDSAALTRAMLHDAGVVLVPGMDFGTHAPKDYIRLSYATAYPKLEEAVGRLAKLFGKD

SEQ ID NO: 18835 - protein, 321 aa, Synechococcus elongatus PCC 6301
MSETQQPTVIITGASSGVGLYGAKALAARGWHVVMACRNLQKAAEAAKSLGINPENYSLMEIDLGSLASVRRFVDQFRATGRSLDALVCNAAVYLPRLKEPQRSPEGYEISVATNHFGHFLLCNLLLDDLKRSPAPEKRLVILGTVTANSKELGGKIPIPAPADLGNLEGLEAGFKAPIAMIDGKKFKPGKAYKDSKLCNMITTRELHRRFHDSTGIVFGSLYPGCVADTPLFRNTPKLFQKIFPWFQKNITGGYFTQELAGERVAQVVADPEFKTSGVHWSWGNRQQKDRQSFVQELSDKASDDRTAQRLWDLSAKLVGL

SEQ ID NO: 18836 - protein, 158 aa, Glycine max
  misc_feature (114)..(114): Xaa can be any naturally occurring amino acid
  misc_feature (145)..(145): Xaa can be any naturally occurring amino acid
  unsure (1)..(158): unsure at all Xaa locations
ALSMIASITDTTVNLAGAGLDATSTGLKPMVGCPTMKTNNDITYIANNGGRAQCMQVWTPFGSKKYETLSYLPDLDEAQSAKEVEYLIKKGWITCLEYKLDHSFLYRELKMPPXYFEGLSWSLWKVPMFGSTDTSHVLNELQYAXTAYPDSQIRIIGF

SEQ ID NO: 18837 - protein, 165 aa, Rhizobium etli
MNPLQTDAQTLLRGVKDLLESTPISAEKCHLGVAPVAIALTQVQAELASAVRPVYTVAQDVSRIAGMGAYTGEVSAELLADSGIGYVLVGHSERREIFGESREILNTKIKNALNAGLTVIYCVGESLEQREAGQAEAVVLQQICDIAAVVEAEQWKNIVIAYEPI

SEQ ID NO: 18838 - protein, 321 aa, Malus x domestica
ILPFKLPAIGPNDVRIRIKAVGICGSDVHYLKTMKCADFEVKEPMVIGHECAGIVDKVGSEVKHLVPGDRVAVEPGISCARCQQCKGGRYNLCPDMKFFATPPVHGSLANQIVHPADLCFKLPKNVSLEEGAMCEPLSIGVHACRRANVGPETTVLITGAGPIGLVSVLAARAFGAPRIVIVDMDDKRLAMAKSLGADETVKVSTKMEDLDDEVAEIKKAMESEVDVTFDCVGFNKTMSTGLNATRPGGKVCLVGMGHGMMTVPLTPAAAREVDVVGVFRYKNTWPLCLEFLRSGKIDVKPLITHRFGFTEKEVEEASLEF

SEQ ID NO: 18839 - protein, 574 aa, Aspergillus oryzae
MSPAPVGEKWWKNSIIYQIYPASFKDSNNDGIGDIPGIISSLDYITSLGVDVIWISPMYDSPQYDMGYDVSDYESVYPPYGTVQDMEVLIDECHRRGLRIILDLVVNHTSHEHKWFKESRSSKASPKRDWYIWKPAKYDANGNRKPPNNWRSIFGGSAWEWDEGSEEYYLHLFCKEQPDLNWENQETRRAIYDSAMEFWLQKGVDGFRVDTVNMYSKHPEYPDAPVIDPKSETQMSPALFCNGPRIHEYLSEMNEVLAKYDAMTVGELPNTHTVDGILRYVSAAQNQLNMVFQFDIVDLGQGKDYKFLTTLPGWTLPELKTAVKGTQVIMKGTDGWSTVFTENHDQGRSVSRFGSEKTPELRVTSAKMLAMMQGTLSGTQFIYQGQEIGMVNAPESWTIDEYKDVDSTNYYQMVQKISNNDPLELETAMKSLQRFARDHARLPMQWSSETHGGFSSSEKTWMRVHDNYPEINVKVQEKDDSSVLSFWKQVIQLRKEYADLFVFGDFEILDEANEKVFTYIKRGQKQSALIVLNFSDDTLKFKQPAGVQDAKVLLRNVEGDLNELQPFEGRVLLF

SEQ ID NO: 18840 - protein, 151 aa, Synechococcus elongatus PCC 6301
MSVERTFIAIKPDGVQRGLVGTIIGRFEQKGFKLVGLKQLKPSRELAEQHYAVHRERPFFNGLVEFITSGPIVAIVLEGEGVVAAARKLIGATNPLTAEPGTIRGDFGVNIGRNIIHGSDAIETAQQEIALWFSPAELSDWTPTIQPWLYE

SEQ ID NO: 18841 - protein, 99 aa, Brassica napus
  misc_feature (5)..(5): Xaa can be any naturally occurring amino acid
  misc_feature (24)..(24): Xaa can be any naturally occurring amino acid
  misc_feature (44)..(44): Xaa can be any naturally occurring amino acid
  misc_feature (50)..(50): Xaa can be any naturally occurring amino acid
  unsure (1)..(99): unsure at all Xaa locations
MAMIXGFLDIFIAIIFFLVFRCLXLYKQTHKPLPTNWSVLGMLXGLLLQXHRIYDWITELLEATGMTFCFKGPWLSGTDILLTVDPVNIHYILSSNFVN

SEQ ID NO: 18842 - protein, 637 aa, Lycopersicon esculentum
MPTLVNYSGDDEFYSGGSFCSADLGLMLSLGHADVYCPPRKRARISGPFVVEDRSKDPSLEVLPDECLFEILRRLPGGRERGAAACVSKRWLTVLSSVKNSEICRSKSYNNLNDAIMISKDEDLEVECDGYLTRCVEGKKATDIRLAAIAVGTSTRGGLGKLSIRGSNSVRGITNVGLSAVAHGCPSLRVLSLWNVPSIGDEGLLEVARECHSLEKLDLSHCRSISNKGLVAIAENCPSLTSLTIESCPNIGNEGLQAVGKYCTKLQSLTIKDCPLVGDQGVASLLSSGASMLTKVKLHGLNITDFSLAVIGHYGKLITSLNLCSLRNVSQKGFWVMGNAQGLQSLVSLTITLCQGATDVGLEAVGKGCPNLKYMCIRKCCFVSDGGLVAFAKEAGSLESLILEECNRITQVGILNAVSNCRKLKSLSLVKCMGIKDLALQTSMLSPCESLRSLSIRSCPGFGSSSLAMVGKLCPKLHQLDLSGLCGITDAGLLPLLENCEGLVKVNLSDCLNLTDQVVLSLAMRHGETLELLNLDGCRKVTDASLVAIADYCPLLIDLDVSKSAITDSGVAALSRGVQVNLQVLSLSGCSMVSNKSVLSLKKLGENLLGLNLQHCSVSCSSVELLVEALWRCDILS

SEQ ID NO: 18843 - protein, 297 aa, Magnaporthe grisea 70-15
MASSGSAVSAVEQAQLIEMAKKAAAFTAVKDHLDPRYTHVGIGSGSTVVYVVEAIKELHPEASKDMTFYPTGDQSKGLIKAGGLRAAPIEDRPQGSLLDVYFDGADEADADLNLIKGGGGCLWQEKIVAVASRTFVCIGDFRKLSRNLGTQWKQGIPIEVLPKAADHVLAELERLGAHSPRLRSGSGKAGSVVTDNGMHIIDAPFTPLLLAGDEGGTGENGIWSVDRLAAKLKSLVGVCEIGLFYGRSGLDAKDEGGAQKPVAAYFGMADGSVQILNQGSPPVTLTTSSTGGSDGSK

SEQ ID NO: 18844 - protein, 665 aa, Lycopersicon esculentum
MSKVFNFSGDHGGTVYPSPKESSLFLSLRNHVDVYFPPCKRSRVAVPFVFSEKKHKLSSIDVLPDECLFEVLRRLSDGKDRSASACVSKRWLMLLSSIRGDETVISNPNPSLETEERSIQTALVKSVDCVKKGEVVDSNAAEVAEAESQDIEGEGHLSRCLDGKKATDVRLAAIAVGTPGHGGLGKLSIRGSNPIRGVTDTGLKVIARGCPSLGLFRLWNVSSVSDEGLTEIAQGCHLLEKLDPCQCPAITDMSLMAIAKNCPNLTSLTIESCSKIGNETLQAVGRFCPKLKFVSLKNCPLIGDQGIASLFSSAGHVLTKVKLHALNISDIALAVIGHYGIAITDIALIGLQNINERGFWVMGNGQGLQKLRSLAITACHGVTDLGLEALGKGCPNLKLFCLRKCTILSDNGLVAFAKGSVALENLQLEECHRITQAGFVGVLLSCGEKLKVLSMVKCFGVKELACRFPSVLPCNSLQSLSIRNCPGVGNATLAIMGRLCPKLTHLELSGLLQVTDEGLFPLVQSCEAGLVKVNLSGCVNVTDRSVSFITELHGGSLESLNVDECRYVTDMTLLAISNNCWLLKELDVSKCGITDSGVASLASTVRLNLQILSLSGCSMLSDKSVPFLQKLGQTLMGLNIQHCNGVSSSCVDLLLEQLWRCDILS

SEQ ID NO: 18845 - protein, 580 aa, Bradyrhizobium sp. BTAi1
MPHETPLIATIVAGLGLAFVFGALAQRFRFPPLVGYLLAGVAVGPFTPGFVADQALATELAELGIILLMFGVGLHFSLKDLMSVRAIAVPGAIVQITVATLMGMALSWAMGWSLGGGLVFGLALSVASTVVLLRALQERRLMDTERGRIAVGWLIVEDLAMVLALVLIPAFASLQNGDGAAVAADPLAARFGLGLTGVLLLTFVKIGVFMALMLVVGRRLIPWILHYIAHTGSRELFRLAVLAIALGVAFGSTKLFGVSLALGAFFAGMMLGESPLSQRAAQESLPLRDAFAVLFFVSAGMLFDPASIIREPWPLLATLFIILFGKSLAAFLIVVAFRHPVSTALTISASLAQIGEFSFILAEIGGATNLLPKAGRDLILAGAIISIMLNPLLFAGLDWLLPRLERRRNDPATPAAAPPAEIPATALTEHTIIVGYGRVGRLVGEALRQRGHALLAVETSDDILKPLKDEGVETITGNAAASHVLRATNPAGAHALVIAIPEAFEAGQIVEQARAANPALHIVARAHSDAEVEHLKSLGADVVIMGEREIARGMIEELGTRPPDAAPALVPHRPAEQVQV

SEQ ID NO: 18846 - protein, 596 aa, Prochlorococcus marinus subsp. pastoris str. CCMP1986
MSNIDLKRRTKIVATIGPATQSEEIITDLIKAGVTTFRLNFSHGDHKDHQERIQTIRKVSEKLDLDIGILQDLQGPKIRLGRFKDGPVKVKKGDKFSLTSNEVECTKSIANVTYNKLAQEVTSGKRILLDDGKIEMIVEKVDIGNNLLECKVTVGGVLSNNKGVNFPDVQLSVKALTDKDIEDLEFGLTAGVDWIALSFVRNPSDINEIKNLINKNGHSIPVVAKIEKFEAIDQIDSILPLCDGVMVARGDLGVEMPAEEVPLLQKELIRKANTLGIPIITATQMLDSMASNPRPTRAEVSDVANAILDGTDAVMLSNETAVGDYPVEAVETMATIARRIERDYPLKAIESHLPSTIPNAISAAVSNIARQLDAGAIIPLTKSGSTARNVSKFRPPTPILATTTERCVARRLQLVWGVTPLLVKNDDRTAKTFSIAMQIAQELGILKQGDLVVQTAGTLTGISGSTDLIKVGLVRKVVTRGISVGEIGVTGKARNIKTNLDLSLISPGEILFVPKNILMDLPFTKIITGIVTDENIDECYKVFKKNNIKISTICNLSAIDNLVSNGDLITLQLNEGVVYMGQIEDDEDALDKYKYV

SEQ ID NO: 18847 - protein, 280 aa, Xanthobacter autotrophicus Py2
MSSQADARRITAPQIQARKGGEPIVSLTSYHSHTARLLDRHVDVILVGDSLGMVMHGMETTVPVTVEMMIVHGRAVVRGTKRALIVVDLPFGSYEASHTEAFHTAARVLKETGAGAVKLEGGRRMAETVRFLVDRGVPVMGHVGLTPQAINTLGSFKARGRDDAEASIILDDARAIAEAGAFSIVLEAIAEPLARRITQEVAPPTIGIGGSPACDGQILVLEDMLGLGDRVPKFVKKYANLGPDIEKAVASYADEVRARTFPAAEHTYAPRLVEKPAKAS

SEQ ID NO: 18848 - protein, 344 aa, Mesorhizobium loti MAFF303099
MSNMMKALVKAKAEPGIWMEEVPVPEIGPNDVLIKIRKTAICGTDVHIYNWDQWAQKTVPVPMVTGHEFVGTVADFGAAVTEYKVGQRVSGEGHIVCGHCRNCRAGRGHLCRNTLGVGVNRPGAFGEYLAIPQHNVVPIPDDVPDEIAAIFDPLGNAVHTALSFDLVGEDVLVTGAGPIGIMGALVAQCVGARKVVITDINPVRLALAKKLGVQHVVDASKEKLRDVMPVLGMTEGFDVGLEMSGAAPAFRDMIDTMNNGGKIAILGIAPTGFEIDWNKVIFKMLHLKGIYGREMFETWYKMIALVQGPLDVSGLITHRIGIDDFQEGFDAMRSGSSGKVVMDW

SEQ ID NO: 18849 - protein, 366 aa, Desulfovibrio vulgaris subsp. vulgaris str. Hildenborough
MSTPDSTTQTWTLPVGPLHVALEEPMYFKLDVDGEIVRNVEITAGHVHRGMEALAMRRNLFQNIVLTERVCSLCSNSHPFTYCMAVEHLAGIEVPARADHLRVVAEEIKRTASHLFNVAILAHIIGFKSLFMHVMEVREIMQDIKETVYGNRMDLAANCIGGVKYDVDAELLAMLLAGLDKVERNAREIYRIYASDPMVTGRTTGIGVLPPDEARRFGVVGPVARGSGLAVDVRRDVPYAAYPQLSFDVITEEGCDVRARALVRLREVFESISIIRQCVATLPEGAMTVIMPEIPAGQSVARSEAPRGELMYYLRTDGTDIPNRLKWRVPSYMNWDALGVMMRDANVADIPLIVNSIDPCISCTER

SEQ ID NO: 18850 - protein, 415 aa, Kineococcus radiotolerans SRS30216
MSPVTAQTSPPASTDVRPRVSARIAGIAESATLAVDAKAKALKAAGRPVIGFGAGEPDFPTPQAVVEAAVAACTDPANHRYTPAGGLPALREAIAAKTLRDSGYEVSPGQVLVTNGGKQAVYEAFAAILDPGDELLLPAPYWTTYPEAARLAGGVAVEVFAGLDQGYKVTVDQLEAARTPRTKALLFNSPSNPTGAVYTPEEVRAIGHWALEHGVWVVTDEIYEHLVYDGVRAASMPVEVPELADTCVVLNGVAKTYAMTGWRVGWLIGPADVVKGAGNLQSHLTSNVANVSQRAAVQALTGDLTAVARMREAFDRRRRTMVRMLDAVDGVDCPLPQGAFYAYPSVQGLIGKSLRGREITSSAVLAELILTEAEVAVVPGEAFGPSGFLRLSYALADEDLVTGVERIQALLSEVR

SEQ ID NO: 18851 - protein, 436 aa, Brassica napus
MKGIRKNYENSYTLSFLLVFFVLILLPPAFSINTLSSEESLTISSNRTLVSRGDVFELGFFKTTSSSRWYLGIWYKKFPYRTYVWVANRDNPLPNSIGTLKISNMNLVLLDHSNKSVWSTNLTRRNERTPVMAELLANGNFVMRDSNNNDASEFLWQSFDYPTDTLLPEMKLGYNLKKGLNRFLISWRSSDDPSSGDYSYKLEPRRLPEFYLLQGDVREHRSGPWNGIRFSGILEDQKLSYMEYNFTETSEEVAYTFRMTNNSFYSRLTLSSTGYFERLTWAPSSVVWNVFWSSPNHQCDMYKICGPYSYCDVTTSPVCNCIQGFRPKNRQQWDLRISLRGCIRRTRLSCSGDGFARMKYMKLPETTMAIVDRSIGVKECEKRCLSDCNCTAFANADVRNGGTGCVIWTGRLDDMRNYVPDHGQDLYVRLAAADLV

SEQ ID NO: 18852 - protein, 568 aa, Medicago truncatula
MASTPPSFSPSRTTCASLLRQLQVIWDEIGESDTDRDNMLLQLEQECLDIYYRKVEQTRKHKADLNKWLDDAESELADIVSSLGDDCVSISRGKGTLKQQLANIRPVLEDLKSRKAERVEEILEIKSQISQICAEIAGCGQSKGVTDQDVDQCDLTMEKLGELKSHLHELQNEKILRQQKVKSHISTISEISAVMSIDIWKTLNDIHPSLSGSSNGAPQCISNDTLARLTGVVLSLKQEKQQRLQKVQELVKFLVELWDLMEIPIDEQKAFSHVTRLISASVDEVSTQGGLSADVIEQVEVEVQQLNVLKASKMKELVFKRQNELEEIYRGVHMDMDSEAARQTLTSLTESGNVDMSELLQSMDEQIRKAKEQALSRRDILDRVEKWKFAAEEEKWLDEYERDQNRYSAVKGAHKNLKRAEKARILVSKIPSVVENLTAKVKAWETEKGIPFLYEKVLLLNSLDEYNVQRQLREEEKRKSREQKRLNEQLAVEQEAMFGSKSATKKPLNQSSHVNTLAGTPNGRRMHTPSGRYGTSGAKDRRESGRVNNIIPVNYVALAKDDSVSRGS

SEQ ID NO: 18853 - protein, 219 aa, Triticum aestivum
RSPGRPTRPPTRPRTRGVKFGHVTFFWNGNRSGYFNPNLERYEEIPSDTGIPFNVQPRMKAVEVAEKARDAILSGKFDQVRVNIPNADMVGHTGDLEATIVGCKAADEAVKIILDAIEQVGGIFVVTADHGNAEDMVKRDKSGKPIRDKDGNVQPLTSHTLNPVPIAIGGPGLAPGATFREDLPDAGLANVAATVINLHGFEAPHHYEPTLIQVSPVPF

SEQ ID NO: 18854 - protein, 223 aa, Campylobacter jejuni subsp. jejuni NCTC 11168
MIFAANLKCNHTRASFKIYAKILNKTMGVKCDDIIVFPPSIAFLENENNFIQGAQNFYPCVNGAFTGELGKEHLDEFGIKCVLIGHSERRALGDEEFIKAKFDFAKEHGYKIVFCIGENLDTKNSGKTLEFLKKQLEIIDLNYEKLIIAYEPIYSIGTGVSAQSTDIAKVLEFLASLTKVPLLYGGSVNENNIKEILSVNHCGGVLIGSAALKVENFIKLIKG

SEQ ID NO: 18855 - protein, 332 aa, Campylobacter jejuni subsp. jejuni NCTC 11168
MAVKVAINGFGRIGRCVARIILERNDIELVAINDTTDIELTKYLFKYDTVHGEFKGSVDSEGDDLVVNGKKIKVFKSRNVKDLDFAKHGAQIVLECTGAHLTMAKCQEFIDMGVQKVIMSAPAKDDTPTYVLGVNSELYKGESIISNASCTTNCLGPVCRVLQDNFGIEKGLMTTIHAYTNGQSIIDAKAKDKRRSRAAAQNIIPTSTGAAKAMKLVMPELNGKLHGQSMRVPVIDVSSVDLTAQLSRKVSKDEINEAFRKAAATNLKGILMVDDDERVSSDFITCSYGAIVASDLTQVIADDFIKVIAWYDNEWGYSSRLVDMAVYIANKA

SEQ ID NO: 18856 - protein, 283 aa, Oenococcus oeni PSU-1
MVLSRSVPNIVLNDGHSLPAIGLGTYLVRGGQGVDQILSAIEDGYRLIDTSTNYDSEGAVGEAIRRSGIPRSEFIVTSKLPGKYHHYQDALMMIQESIFRMGIDYLDLYLIHWPLPKRDHYVEAWKALVDAQKLGLIRSIGVSNFLPEHLDRIINESGVTPAVNQIEVHPYWVQEDMLAANKSRGIVSEAWSPLGRGSAALKEDIIKNLADKYGKNTGQIILRWHTQRGIIPLPKASSLIHQRSNIDIFDFSLTSSEIEQINALNRSDGRVDGQDPNTYEEFD

SEQ ID NO: 18857 - protein, 336 aa, uncultured gamma proteobacterium
MNVLEQTLILQLADGQFHSGTALGQQTGRTRTAVWKAIRSLQQNGLSIYSVRGKGYRLAEAVELLNREEILTLLNEVEVRKNAPKYLQQLDVFYDIESTNAYLLDVAKKSPQTAHACLAEQQSSGRGRRGRHWISPFGGNLYFSLLWQFSAGASQLGGLSLAVAVAVMRVLAALGLRSAGVKWPNDILVNGKKLAGILLEVSGEAAGPCAVVIGVGLNVRGGGQAMSALDQPWTDLETGLGKPVSRNHLASQLICHLIDVLREFETGGLSPFLKEWAIYDVFADSKVVLNTPQGNIHGIARGVDETGALILVTTEGVQRYHSGEVSLRAVPARGTN

SEQ ID NO: 18858 - protein, 510 aa, Gluconobacter oxydans 621H
MSASSTPRPVMLVILDGFGWREDESDNAVRLANTPTFDTLWATSPHAFLKTSGEDVGLPDGQMGNSEVGHLNIGAGRVVMQELPRISRSARDGSLAQNPALLEFIAALKASGGTCHLMGLISPGGVHAHQDHVVALTKIVSAAGVPVAVHIFSDGRDTAPRSGEDFIGKFLKELPDSVQIATLSGRYYAMDRDRRWERVALAVEAIRDAKGPHAKDALSALQASYASDKGDEFVLPTVLGDYAGMKDGDGILACNFRADRIRQLLDVLVLPDFTEYDSGRKVKFAAVCGMSRYSDHLAPYMSILFPKVPLDDLLGDVVAKAGRTQLRMAETEKYPHVTYFLNGGREVQFDGEERILVPSPKVATYDLQPEMSAPELTDKAVAAIESGKFDMIVLNFANPDMVGHTGSLSAAIKACETVDQGLGRINDAIVKAGGVLLVTADHGNCETMRDPVTGGAHTSHTLNVVPVILAHARGETIHDGRLADLAPTMLALMGVKQPDAMTGVSLLESA

SEQ ID NO: 18859 - protein, 463 aa, Yersinia pestis biovar Medievalis str. 91001
MELPVKNKLKRGLTTRHIRFIALGSAIGTGLFYGSADAIRMAGPSVLLAYLIGGVVAFVIMRALGEMSVNNPQASSFSRYAQDYLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMLLSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 18860 - protein, 829 aa, Lycopersicon esculentum
MSGRRSSYTLLNQIPNDNFFQPPAPKFSAGAGVLPYGESSSAEKNRGKVFDLDLMDQRMMQSHNRVGSFRVPGSIGSQKQSTEGSFRGSSLSGENYVGTSFGHKNEGCGSSVARNWAQQTEESYQLQLALAIRLSSEATCADSPNFLDPVTDVLASRDSDSTASAVTMSHRLWINGCMSYFDKVPDGFYWIYGMDPYVWALCSVVQESGRIPSIESLKAVDPSKAPSVEVILIVRCNDLSLKELQNRIHSISPSCITTKEAVDQLAKLVCDHMGGAAPAGEEELVSMSKGCSNDLKDRFGTIVLPIGSLSVGLCRHRALLFKVLADIIDLPCRIAKGCKYCNSSDASSCLVRFEHDREYLVDLIGKPGVLSEPDSLVNGPFSISIPSPLRFPRYRQVEPTTDFRSLAKQYFLDSQSLNLLFDDSSAGAAADGDAGQSDRSCIDRNNVVSSSSNRDEISQLPPPPLNAWKKGRDKESQLSKMYNPRSMLNPVNMDEDQVLVKHVPPFREDAQSPMTRPDTVNDTRFLAGGGHVVSAIPSEELDLDVEEFNIPWNDLVLMEKIGAGSFGTVHRGDWHGSDVAVKILMEQDFHAERLKEFLREVAIMKRLRHPNIVLFMGAVIQPPNLSIVTEYLSRGSLYRLLHKPGAKKVLDERRPLCLAYDVANGMNYLHKRNPPIVHRDLKSPNLLVDKKYTVKICDFGLSRFKANTFLSSKTAAGTPEWMAPEVIRDEPSNEKSDVYSFGVILWELATLQQPWNKLNPPQVIAAVGFNRKKLDIPSVLNPRVAIIIEACWANEPWKRPSFSTIMDMLRPHLKSPLPPPGHTDMQLLS

SEQ ID NO: 18861 - protein, 609 aa, Yersinia pestis biovar Medievalis str. 91001
MLSGWHLPVSPFVRLADDALHITLWLQGDSLPAQVFLRCEPDNEEWLLTMEGHESHDRWRYSVSLPLYEGQPTRRYCFKLLWDDRQQWFGPLGFSVIPPAQLAQFAVDVPDSGPDWVADQVFYQIFPDRFASSQADHGVQEGSYIHHAAGCPVSRREWQQPLDDVHAASTFYGGDLAGISQKIPYFQQLGVTALYLNPIFTAPSVHKYDTEDYYQVDPYLGGERDFLQLRAATREVGIKLVLDGVFNHTGDSHRWFDRYQQGENGACHHEDSPYRGWFTFLPDGRALDWKGNASLPKLNFANEEVAERIYRSDDSVVRYWLRPPYSIDGWRLDVVHMLGEDGGAKGNLHHLHGIYQAAKEENPQAYILGEHFGDARNWLHAGVEDAAMNYMGFALPVRSFLAELDVACHPIKLDAADCAYWMDEYRAGLPHSQQLRLFNQLDSHDTARFLTLLKGDKTRMQMALIWLFSWIGVPCLFYGDEIGLDGGNDPFCRKPFPWDEAQWDHDLLSLCQRMAALRHKSIALRRGGCQVIHASGDSLVFIRSYQTERVMVAIQRSDDADIFLPASPLLNVAEWQRLEGGGDLAVSETGVNMGLEGKSVTLWCGVGEC

SEQ ID NO: 18862 - protein, 230 aa, Burkholderia vietnamiensis G4
MTQDELKRLVGQAAADYVIQNVPEGAVIGVGTGSTANCFIDALAAVKSRYRGAVSSSVATTERLKSHGIKVFDLNEIDALQVYVDGADEIDASGAMIKGGGGALTREKIVASVADTFVCIADGSKRVPVLGAFPLPIEVVPMARTAIGRRVAALGGVPVLRVTKDGAPYITDNGNEIIDVKGLQIAEPRAFEAKVNAWPGVVTVGLFAERGANLCLLGTENGVETIIYPA

SEQ ID NO: 18863 - protein, 480 aa, Haloarcula marismortui ATCC 43049
MSKCRRKRRNLCANQQGFSSSTAPIGCPKMTSELSEAAQEVLDEIDEKNVDFLRLQFTDILGTIKNVSITADQAEKAFTEGIYFDGSSINGFVRIQESDMRLDPDPSTFSVLPWRENVEGGSSARLICDVIDTSTGEPFSGDPRGVLKRAIERANDMGYTVNAAPEPEFFLFEEDEEGRATTKTNDAGGYFDLAPKDLASDVRRDIIYGLEDMGFDIEASHHEVAQGQHEINFTYDDALSTADNVATFRSVVRAIAAEHDLHATFMPKPIPKINGSGMHTHLSLFTEDGENAFHDEDDEFNLSETAKSFTAGILKHAPAITAVSNPTVNSYKRLVPGYEAPVYVAWSDRNRSALIRKPAARTPAASRIEARFPDPSCNPYLAFAALIHAGLDGVEQDLECDDPVRENIYDFDEEKREEYGITTLPSNLGEAVEALEDDEVIQDALGEHVYENFVEAKTQEHKEYLVDVSDWELDRYLEKF

SEQ ID NO: 18864 - protein, 351 aa, Rubrivivax gelatinosus PM1
MDPIELEQWLSAHPPALADVIRHVAAACARISRAAARAPLAGQLGGAGSLNSQGEPQQRLDVLADACVSQALSACTHVAGWVSEEHADVTVSPEHGSGGAYLVVFDPLDGSSNVETNVAIGSIFSVLPHLFRGTPASAAAFMQPGRRQVAAGYAIYGPSTVLVLSLGQGVHMFTLDPDAPGDAARWVLTRADVEVPVSTTEFAINASNQRFWEKPVQRYVAECLAGQSGPRGRDFNMRWVASLVAEVHRILTRGGVFLYPRDSREPFRPGRLRLLYEAAPMAWLMEQAGAAATTGTGPLLELVPDALHHKVPVILGSRDEVERIVTYHEDPSANVSWQLFKTRSLFIQPQA

SEQ ID NO: 18865 - protein, 353 aa, Xylella fastidiosa 9a5c
MRGYVLEAKGTAKWKDVPMPVLGPNDALVRPTAVATCTTDVHMIATAALPKTVGKVIGHEAVGVVEKVGENVKAFRPGDRVVLPCGNSDWRHPRAQRGEAKYYQTNSPYYSDDPSIGGVFSEYVRTLDADLNLARIPDKVSDLQAVMLPDMAATGFTGVERLGIQFGETVLVMGLGPVGLMAVAGAALRGAGRIIGVDSRPNTVELARAYGVTDIVDFTGGQTLEKVMALTAGQPVDSVLIASGGTASEVFTTALKAVKFGGRVACVSGFLHDESVTIPLEVWNYGFMEKFLTGVHVQDGRDWIERLLAMLECGRFDTRPLVSHVLHGWDSLEQGIELMRSRDPAVIKPVIVI

SEQ ID NO: 18866 - protein, 333 aa, Arabidopsis thaliana
  misc_feature (14)..(14): Xaa can be any naturally occurring amino acid
  unsure (1)..(333): unsure at all Xaa locations
MATSTTMSHQAIGXSVVSQRPFKASQFLKEPLNNVPMKFRQKRFKIEATASQISVVDNTFLSPSPSKNKPHESKKKSNEAALILIRHGESLWNEKNLFTGCVDVPLTQKGVGEAIEAGKKISKIPVDLIFTSSLIRAQMTAMLAMTQHRRKKVPIILHNESVKAKTWSHVFSEETRKQSIPVIAAWQLNERMYGELQGLNKKETAERYGTQQVHEWRRSYEIPPPKGESLEMCAERAVAYFEDNIKPELASGNNVMIAAHGNSLRSIIMYLDDLTSQEVTTLDLSTGVPLLYIFKEGKFMKRGSPVGSTEAGVYAYTKRLAQYREKLDAAATI

SEQ ID NO: 18867 - protein, 473 aa, Prochlorococcus marinus subsp. pastoris str. CCMP1986
MAKSPQDVLSQIKDEGIELIDLKFTDIHGKWQHLTLTSDMIEEESFTEGLAFDGSSIRGWKAINASDMSMVPDSSTAWIDPFYKHKTLSMICSIQEPRSGEPYNRCPRSLAQKALKYLDSTGIADTAFFGPEPEFFLFDDVRYDSKEGSCFYSVDTIEAPWNTGRTEEGGNLGYKIQYKEGYFPVAPNDTAQDIRSEMLLQMAELGIPTEKHHHEVAGAGQHELGIKFDSLISSADSVMTYKYVVRNVAKKYGKTATFMPKPVFNDNGTGMHVHQSLWESGQPLFYGEGSYANLSQTARWYIGGILKHAPSFLAFTNPTTNSYKRLIPGFEAPVNLVYSEGNRSAAVRIPLTGPNPKAKRLEFRSGDALANPYLAFSVMMLAGIDGIKNQIDPGDGVDVDLFELPAEELSKIDTVPSSLNDSLNALKADKDYLLAGGVFTEDFIDNFIDMKYEEVQQLRQRPHPHEFFMYYDA

SEQ ID NO: 18868 - protein, 571 aa, Arabidopsis thaliana
MNHSTSDQSLYIESDDGDDERKHLSDDEDDDGTLSDTSDAYNQNQHHLSKASPYSTAWPKSYRQSIDMFGSVPSPNLGFLANSSMSRRGSSFMSSTLTRRHTPESLPCVTKPLLEDEEAPKHKLSTHSLLPSKPSSSMVVSHDMGISNDSSFGQAVLNGVNVLCGVGILSTPYAVKEGGWLGLIILFAFGILCFYTGLLLRYCLDSHPDVQTYPDIGHAAFGSTGRILVSVILYMELYAMSVEYIILEGDNLSSMFPNASLSIGGFHLDAPRLFALLTTLAVLPTVWLRDLSVLSYISAGGVIASVLVVLCLFWVGLVDDVGIHSKGTPLNLATLPVSVGLYGYCYSGHGVFPNIYTSMAKPSQFSAVLLASFGICTLMYAGVAVMGYSMFGESTESQFTLNLPQDLVASKIALWTTKESTYALTLSPVAMSLEELIPSNYGKSRFYAIAIRSALAISTLLVGLAIPFFVNLLSLTKFLDTDADTTASLFLEHLKEKSNPYSDLVSQTLQVKTIMKSCLGFIFNWDLYFTIISSEGVAGEGTLADSVAEFDELQTLVTEASFASRITDNCL

SEQ ID NO: 18869 - protein, 177 aa, Silene latifolia subsp. alba
MASLMSNAAVVTASTAAQANMVAPFSGLKSTSAFPVSRKSNVDITSLATNGGRVNCMQVWPPRNLKKFETLSYLPTLSEESLLKEINYLLIKGWVPCLEFEVGPAHVYRENNKSPGYYDGRYWTMWKLPMFGCTDASQVAAEVVECKNAYPDAHVRIIGFDNKRQVQCISFIAYKPE

SEQ ID NO: 18870 - protein, 342 aa, Gibberella zeae PH-1
MSTTNSGQESEKVNTNIVTLTRFLTEEQAKHPEATGDFTLLCHALQFSFKSIAYYIRRATLVNLTGLAGSSNITGDDQKKLDVISNDLFIEAMRSSGKCALLVSEEEDEIIYFKDASDARYAVACDPIDGSSNLDAGVSVGTIFAIHKLPEGSKGCKEDILKPGTELLAAGFTMYGASAQLVITMRGGTVNGFTLDNGVGEFILSHPNMRLPKSRDIYSCNEGNSLYWDDKTINYFNSLKQAQENGKPYSARYIGSMVADAYRTLLYGGIFAYPADKKSPKGKLRILYECAPMALIFENAGGQAVDSKMNRLLEVVPEHIHDKAGIFMGSYDEVEKVKKFHQ

SEQ ID NO: 18871 - protein, 347 aa, Halobacterium sp. NRC-1
MRAAVYQGPGEIAVEEVPKPDIESPEDAVIRVTHTAVCGSDLWFYRGDSDREAGSRVGHEPMGIVEEVGDDVTSVAPGDRVIAPFAISCGECEFCRQGLYTSCVEDESWGSEANGGGQGEYVKCPFADGTLVRVPDRYADDEDVLESLLPLTDVMGTGHHAAVSAGVGEGDTAVVVGDGAVGLCGVLAAQRLGAERIIAMGHHEDRLELAAEFGATDTISARGDDAIERARDLTHGGANHVMECVGAASAMDSAIAIARPGGTVGYVGVPYGVEDGGLDVFTMFSDNITIRGGVAPVRAYAEELMADVLQGTLDPSPIFTKTVDLDGVPEGYAAMDDREAIKVLVKA

SEQ ID NO: 18872 - protein, 672 aa, Desulfovibrio vulgaris subsp. vulgaris str. Hildenborough
MQLPLLPDIVVLFCLSIGVLLVCHRVRLPAIVGFLITGVLCGPSALGLVSAVHEVELMAEIGVVLLMFTIGMELSGDELSRLRKPVFIGGTAQVGLTVAVFAGIALLHGQTLSEGILFGFLAALSSTAIVLSLLQQRAQTESPQGRIALSVLIFQDIAIVPMMLAIPLLAGTITADAKSLALSVGRTVAVLGGLVLLARYVVPPLMERVVRTRSRELLLLTTLGLCLAVALLTSSMGLSLSLGAFLAGLLLAESEYSLSVIEGVLPFRDVFTSLFFISVGMLLDVGFLFDNLGAVLAVAAALVVLKAAIATPAILLLGYPLRTCIIAALALAQIGEFSFVLARSGLEHGLLGKDAYQMFLAASIITMTLTPGLLAVAPRFARYVSTLLKSHETFDEAHGAALHDHLIVVGFGVGGKHLARVAREAGIAYTILEMNPDTVARYHGKEPIHHGDATHPLVLEHLGVRQARILAVVISDPAAVRGVTAAARALNPALHIVVRTRFLGEVTALRDLGANEVVPEEFETSIEVFSRVLTHYLVPRQTIDGFIDRIRAENYDMLRSHDLPGSTLAALEGGLPGVAVEAYTVEAGASIAGRTLLESDLRQRHGVTVVAIRRGETTLASPDGSMALLPGDVAYVFGEPTALHDAAALFSKATGDAPFAERVPSSVSETAA

SEQ ID NO: 18873 - protein, 1244 aa, Arabidopsis thaliana
MASRHQSTSFKPLAVGRNLTGDDDDGYCTLIDFAGSGGGEGKNVGEDLVVLLYHLQHACKRIASLVASPFNSSLGKLSVNSSSGSDRDAPKPLDIVSNDIVLSSLRNSGKVAVMASEENDSPTWIKDDGPYVVVVDPLDGSRNIDASIPTGTIFGIYNRLVELDHLPVEEKAELNSLQRGSRLVASGYVLYSSATIFCVTLGSGTHAFTLDHSTGEFVLTHQNIKIPTRGQIYSVNDARYFDWPEGLRKYIDTVRQGKGQNPKKYSARYICSLVADLHRTLLYGGVAMNPRDHLRLVYEGNPLAFLVEQAGGKSSDGKRGILSIQPVKLHQRLPLFLGSLEDVAELESYGDVQQTVNPGYETTKDFSQVLCAGNRRDEIGEGERGEIMERNSVKFHAEKRSGAFDPGSGFGSSKRVKTHHTQLLSALVVPVGHAAFRLLCPLSHVGAVIGKSGNVIKQLQQSTGAKIRVEEPPSGSPDRVITIIAQADSKSRVKLGANNNGNAEGEKKEEEVEVSKAQGALIKVFELLAAEADSDTVVCRLLTESSHAGAVIGKGGQMVGSIRKETGCKISIRIENLPICADTDDEMVEVEGNAIAVKKALVSISRCLQNCQSIDKVRMVGNRPLEKEFQASLHRPIETIIQESLPRSVEVNPYDYRLRNDEIFPRGTVARANDVIPHDTLHLRRIEAVPQGALRMHIEADRQDVLRRHVEADRQDALRRRIDVVPQETLYMPSDVLRGDCFRQHRERDDSHDSLHRPFEMVPRDAMGMPFESFPRDAYGRPIETMTQETLRGQSADYLAHRYSTLDTHPHSFTTSASMANTATMKPPPSEVEVGNQDVVFKILCSTENAGGVIGTGGKVVRMLHSETGAFINVGNTLDDCEERLIAVTASENPECQSSPAQKAIMLIFSRLFELATNKILDNGPRSSITARLVVPTSQIGCVLGKGGVIVSEMRKTTGAAIQILKVEQNPKCISENDQVVQITGEFPNVREAIFHITSRLRDSVFSNSMKNSLAKSSSALTTERFYDRQSDNPLSIGSHQSVSNPATNSSSLHRRSEDSFLSGSHSSVNYSRSVGTDPYIRPEDPFPDRFNPSAGYSHNFGRRFTMDHSDNSHHLTEAPSRLWASPPPAAPRGLSDASGGLSSARAGHVLGSGHKSAIVTNTTVEIRVPANAMSFVYGEQGYNLEQLRQISGARVIIHEPPLGTSDRIIVISGTPDQTQAAQNLLHAFILTGETSLSKKYNLN

SEQ ID NO: 18874 - protein, 409 aa, uncultured archaeon GZfos37B2
MMKVIRDPIHGYIELDEAALSLVDTPVMQRLRRIKQLGLTSFVYPGANHTRFEHSLGTYHLANLLMDCMGKESEYGKGVEGGTDVRAGKTELRVAALLHDIGHGPLSHVTENIIRKHTGRSHEDVYHILESNLGEIFDRYSISISRVAKHIKGETGFGAALNSEIDIDRMDYLVRDAHYTGVPLSVDLVRLIHEMRFQDGKLVIGSGGIRAAESLLLSRFLMYPTVYYHHVTRIAESMCVRAVERMIEDGFDARILHKMDDQELFMHLGSYPGYPTEIADSLRNRRLFKRAFYEGFDVVGESVLSHRRNVRRVEDEIASAAGVDPEYVLVDIPKPPEIVESRAFVVIDQRLNPLHEVSHLVSALGHAQRDNWRMGVYTPSEYRGVVAAAARGFFGVRKHKQFRLDELIT

SEQ ID NO: 18875 - protein, 252 aa, Nicotiana tabacum
MEKEREKQVYLARLAEQAERYDEMVEAMKTVAKMDVELTVEERNLVSVGYKNVIGARRASWRILSSIEQKEESKGHDQNVKRIKTYQQRVEDELTKICIDILSVIDEHLVPSSTTGESTVFYYKMKGDYYRYLAEFKSGDDRKEAADQSLKAYEAATATASADLAPTHPIRLGLALNFSVFYYEILNSPERACHLAKQAFDEAIAELDSLSEESYKDSTLIMQLLRDNLTLWTSDLEEGGEHSKGDERQGEN

SEQ ID NO: 18876 - protein, 208 aa, uncultured archaeon GZfos37B2
MILLYDAADREGETDFMIPARSIRPQDIAEMRIYGGGLLCAVIPDTAAERLGLPFAADILRRLPDLAHLAEGDLHYDTRSSFSLWVNHRDTFTGIPDRDRALTIHKLDEIVESALHGDMVDFSSEFRSPGHVAVLRGAKDLLKERKGQTELSIALAELAGINPVLCICEMLDSETGYALTKEDAKKYAMKNDMVFVEGGEVVSGYEKG

SEQ ID NO: 18877 - protein, 957 aa, Salmonella typhimurium LT2
MTQTLSQLENRGAFIERHIGPDAAQQQEMLNAVGAESLNALTGQIVPKDIQLATPPQVGEAATEYAALAELKAIAGRNKRFTSYIGMGYTAVQLPPVILRNMLENPGWYTAYTPYQPEVSQGRLEALLNFQQVTLDLTGLDMASASLLDEATAAAEAMAMAKRVSKLKNANRFFVASDVHPQTLDVVRTRAETFGFDVIVDDAAKALDHQDVFGVLLQQVGTTGEIHDYSALITELKSRKVVVSVAADFMALVLLTAPGKQGADIVFGSAQRFGVPMGYGGPHAAFFAAKDEFKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAAVLARAEAAEINLRSDIHNAVGITLDETTTRENVAQLFNVLLGDSHGLNIETLDKDVALDSRSIQQSMLRDDAILTHPVFNRYHSETEMMRYMHSLERKDLALNQAMIPLGSCTMKLNAAAEMIPITWPEFAELHPFCPPEQAEGYHQMISQLSDWLVKLTGYDAVCMQPNSGAQGEYAGLLAIRHYHESRNEGHRDICLIPASAHGTNPASAHMAGMQVVVVACDKNGNIDLDDLRAKAEQHAANLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKQASQVAILNANYIASRLKDAYPVLYTGRDGRVAHECILDIRPLKEETGISELDIAKRLIDYGFHAPTMSFPVAGTLMVEPTESEGKAELDRFIDAMLAIRAEIDQVKAGVWPLEDNPLVNAPHIQSELVAEWAHPYSREVAVFPAGVADKYWPTVKRLDDVYGDRNLFCSCVPISDYQ

SEQ ID NO: 18878 - protein, 463 aa, Yersinia pseudotuberculosis IP 32953
MELPVKNKLKRGLTTRHIRFIALGSAIGTGLFYGSADAIRMAGPSVLLAYLIGGVVAFVIMRALGEMSVNNPQASSFSRYAQDYLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMILSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 18879 - protein, 806 aa, Lycopersicon esculentum
MSGRRSSYTLLNQIPNDNFFQPPAPKFSAGAGVLPYGESSSAEKNRGKVFDLDLMDQRMMQSHNRVGSFRVPGSIGSQKQSTEGSFRGSSLSGENYVGTSFGHKNEGCGSSVARNWAQQTEESYQLQLALAIRLSSEATCADSPNFLDPVTDVLASRDSDSTASAVTMSHRLWINGCMSYFDKVPDGFYWIYGMDPYVWALCSVVQESGRIPSIESLKAVDPSKAPSVEVILIVRCNDLSLKELQNRIHSISPSCITTKEAVDQLAKLVCDHMGGAAPAGEEELVSMSKGCSNDLKDRFGTIVLPIGSLSVGLCRHRALLFKVLADIIDLPCRIAKGCKYCNSSDASSCLVRFEHDREYLVDLIGKPGVLSEPDSLVNGPFSISIPSPLRFPRYRQVEPTTDFRAAADGDAGQSDRSCIDRNNVVSSSSNRDEISQLPPPPLNAWKKGRDKESQLSKMYNPRSMLNPVNMDEDQVLVKHVPPFREDAQSPMTRPDTVNDTRFLAGGGHVVSAIPSEELDLDVEEFNIPWNDLVLMEKIGAGSFGTVHRGDWHGSDVAVKILMEQDFHAERLKEFLREVAIMKRLRHPNIVLFMGAVIQPPNLSIVTEYLSRGSLYRLLHKPGAKKVLDERRPLCLAYDVANGMNYLHKRNPPIVHRDLKSPNLLVDKKYTVKICDFGLSRFKANTFLSSKTAAGTPEWMAPEVIRDEPSNEKSDVYSFGVILWELATLQQPWNKLNPPQVIAAVGFNRKKLDIPSVLNPRVAIIIEACWANEPWKRPSFSTIMDMLRPHLKSPLPPPGHTDMQLLS

SEQ ID NO: 18880 - protein, 609 aa, Yersinia pseudotuberculosis IP 32953
MLSGWHLPVSPFVRLADDALHITLWLQGDSLPAQVFLRCEPDNEEWLLTMEGHESHDRWRYSVSLPLYEGQPTRRYCFKLLWDDHQQWFGPLGFSVIPPAQLAQFAVDVPDSGPDWVADQVFYQIFPDRFASSQADHGVQEGSYIHHAAGCPVSRREWQQPLDDVHAASTFYGGDLAGISQKIPYFQQLGVTALYLNPIFTAPSVHKYDTEDYYQVDPYLGGERDFLQLRAATREVGIKLVLDGVFNHTGDSHRWFDRYQQGENGACHHEDSPYRGWFTFLPDGRALDWKGNASLPKLNFANEEVAERIYRSDDSVVRYWLRPPYSIDGWRLDVVHMLGEDGGAKGNLHHLHGIYQAAKEENPQAYILGEHFGDARNWLHAGVEDAAMNYMGFALPVRSFLAELDVACHPIKLDAADCAYWMDEYRAGLPHSQQLRLFNQLDSHDTARFLTLLKGDKTRMQMALIWLFSWIGVPCLFYGDEIGLDGGNDPFCRKPFPWDEAQWDHDLLSLCQRMAALRHKSIALRRGGCQVIHASGDSLVFIRSYQTERVMVAIQRSDDADIFLPASPLLNVAEWQRLEGGGDLAVSETGVNMGLEGKSVTLWCGVGEC

SEQ ID NO: 18881 - protein, 209 aa, Bacillus cereus E33L
MKRVGKEFFLQHDIVIMYSILFVFIIILKMQFFTWIGLLSCLFGIIFYTLNEYMTHRFLFHLKPPKNVFLLKMLRRLHYDHHVYPDDLKLLFLPVWFSIPSFTIYLLISYAITKSVTIALSFGIGMIIMLLVYEWKHYIAHKPIRPVTKFGRWLKKQHILHHYKNEKFWFGVSNPVFDFIFGTLKDGKDVELSETARNLEKEKKKKVVR

SEQ ID NO: 18882 - protein, 269 aa, Salmonella enterica subsp. enterica serovar Typhi
MEKKIGFIGCGNMGKAILGGLIASGQVLPGQIWVYTPSPDKVAALHDQYGINAAQSAQEVAQVADIVFGAVKPGIMVKVLSEISSSLNKDSLVVSIAAGVTLDQLARALGHDRKIIRAMPNTPSLVNAGMTSVTPNALVTPEDTADVLNIFRCFGEAEVIAEPMIHPVVGVSGSSPAYVFMFIEAMADAAVLGGMPRAQAYKFAAQAVMGSAKIVLETGKHPGELKDMVCSPGGTTIEAVRVLEERGFRAAVIEAMTKCMEKSEALSKS

SEQ ID NO: 18883 - protein, 389 aa, Rickettsia prowazekii
MTNKTITLNLGPQHPATHGVLRLILEMDGEVVNNADPHIGLLHRGTEKLIEHKTYLQAIPYFDRLDYVSPMCQEHAFALAVESLLECSVPRRAQFIRVLFSELTRILNHTLNIGSQALDIGATTPLLWLFEEREKIMEFYERVSGSRMHSNYFRPGGVAEDLPENLLEDINKFIEQFPSKLNDIENLLNENRLWKQRLVDIGVVSQKDAMDWGFSGPMLRGSGIAWDLRKSNPYDVYDEMDFEVPIGKNGDCYDRYLVRILEMYESIKIIKQCIVKMPKGQVKTDDPKLTPPTRGKMKESMEAMIHHFKLYTEGYDVPIGETYKAVEAPKGEFGVYLYSQGGNKPYRCRIKAPGFAHLQGLNFMSKGHLIADVITIIATLDIVFGEIDR

SEQ ID NO: 18884 - protein, 105 aa, Gossypium hirsutum
MARSVSSFKLLGASIFDGLYVSISRRGYSGAPPAAVTASFGRPGAMGKVERRDAMKESSSSETRAYSSAWAPDPVTGYYRPENCGAEIDAAELREMLLNHRVRSQ

SEQ ID NO: 18885 - protein, 400 aa, Erwinia carotovora subsp. atroseptica SCRI1043
MPDIADRLNNIAISASVAMTQKARDLAAQGIDVVGLSTGEPDFPTPVHAIEAAYAAALAGDTRYPPTDGTPTLRAAIQRKFKRDNHLNYDISQIITSGGARQIIFNAMMATINPGDEVVIPTPSWISYADIVKFAGGTPVPVACREEHGFKPLSQDIAHAITPKTKWLLLNYPSNPTGSVASRSELQAIADVMLDNPHVWVMTDDIYEHLIYDDCEFLTMAQVEPRLFDRVLTVNGVSKAYSMTGWRLGFCGGPVALIKAMSNVNTQNAGGIATLAQAAAIAVLDGPQDLLKERAAIYRQRRDFVLEKLAAIDGLRCHKPQGAFYLFVNIAHFIGKTSAGGRRIESDADFVMALIEEQHVVTVQGAAYGMSPYIRLSYATSMERLETGCARLGAFCNGCH

SEQ ID NO: 18886 - protein, 532 aa, Cryptococcus neoformans var. neoformans JEC21
MSTRPPTSPDAVDANKKQKTVQVNKKVCLIVHDGWGLSTEEKGNAIFHGDTTHMDAIRDKHNFVELEAHGLAVGLKEGLMGNSEVGHLNIGAGRIVWQDIVKIDQSIKKDEFKDQPAIVDAMKHAKETSGRLHLLGLISDGGVHSHIQHLFALLRVAKSYGIANVYIHFFGDGRDTAPKSATKYIKQLQDYIKEVGVGEISTVIGRYYAMDRDKRWDRIKIAVDGLVKGEGEKTDQEGLIKTVEDGYEKDVTDEFIKPIISGSEDSRIKKGDSLYLFNYRSDRMRELAQVLGLPDKPMEVDVPEDLHITTMSRYNIEFPFPVAFPPQAMTNVLAEWLAKQGVKQCHIAETEKYAHVTFFFNGGVEKQFENEKREMIPSPKVATYDKQPEMSVQGVADKVAETVKSDKYEFVMCNFAPPDMVGHTGDYDAAVKAITATDAAVKTVYDACEEAGYVLCVTADHGNAEQMLDPETGNPHTAHTTNHVPFIVTGDKGSLEVSEEPGALADVAPTILDILGLPKPEEMSGRSLLSKK

SEQ ID NO: 18887 - protein, 535 aa, Candida albicans SC5314
MPSPDLTDPPSAPKQRRRSFMDYGGPNSINNFASSYSRAQQYIGTSFMEQGGEYMESPPQIPSRPLHEDNEAFISSDDNSIRSDNNSNNQTEHMDFPLPPPIDWSNNSVFDETSELLPTLSRVSTKRHSFSLITGNSTAAQTIFNSINTLIGIGMLSLPLGFKMSGWLFGSLLLVVSAFLTNTTAKYLGKILYRHQELMTYGDIAYAYGGKYFSYLVTLFFVIDLFGASLTLIILFADSFTIVWPHVPALKAIIVAVVFVLSLLPLSMLSIFSLLGIISTVGIILSVFICGFLVDTSPGSLLIPATTTLLPPNPINLLFSLGIFMAPWGGHPVFPELYRDMRHPFKFTKSSNISFLVTYLLDFSIGATGYLMYGLMVDDSIVKSIMQNPNYPPIINSILCILMGILPISKLPLVTKPIITSYENIFGITAKYVKLDENGKLTDTYGPTRVFSRLLFCCVLLISALLLTSFGKLVAFLGSAICYTVCLTLPLLFYLKLNRSSVGKLEGLLIKIGIVFSITATILGTYASIGLTIPE

SEQ ID NO: 18888 - protein, 2505 aa, Oryza sativa (indica cultivar-group)
MVSSSSPVVNVYPLANYTFGTKEPKMEKDTSVADRLARMKVNYMKEGMRTSVEAILLVQEHNHPHILLLQIGNTFCKLPGGRLKPGENEIEGLKRKLCSKLAVNSPSFPPNWQVGECVAVWWRPNFETVMYPYCPPHITKPKECKKLFIVHLSEREYFAVPRNLKLLAVPLFELYDNVQRYGPVISTIPQQLSRFQFNMWASGSPPTSPVSGVRRGACRRAPRKPLPPIAAHVPPFPAPTSTAIAMGKPKQQVLSRFFSPKPRPSAPATADDPPPPPRPPAEPPVAAVVSFSPAKRARALSVSPKTTAKRAKPSPPPSDYVRRRLLEPPRPPPPAALNPSGKGYTPLEQQVVDLKARHPDVLLMVEVGYRFRFFGEDAAVAASVLGIIAHPDHSFLTASIPTFRLGFHVRRLVAAGHKVGVVRQTETAAIKAAHGGGAAGTPFARGLSAVYTRATIEAAAGELEGGGAPDEGSRYLVCVVDKEVDAMGTEGFEVKIGVVAIEVSTGEVVHGEFMDGVSRNGLEAVLLGLAPVEVILGTPISSATEKLMVAYAGPTSNVRVERTSRLCFSEGGALAELLSLFEKSGVDAPTVENGRHLMEMNEENNNPRGIEVPLSSSELTVIAPYDWVSICSLGIMAMPELVIHALALSVRYLKGFGMDRIICFGSSFQPFTANTEMSLSANTLQQLELTHPLCDRNQICTRHDAVSEISESIGSQQYSTNNLQDEVDMSCSSSVRSDLSTILSSVLRMLAGTLDIQRGITRIFHCKATAKEGTSNDTPFGLIILVVLDKDEFVGVVQAILTAGKQLQKLVLEDTDTMSSQHRTVHSPLLRRLINTASSCTVLANAATLVSCLNKDAADQGDMLNLFIASVDQFPEVAEGHATVEMAKQKLELLITEYRKQLGLPVDRKVPSSWMKVNSTKKTIRYHTPEVSKNLENLLLAKEKLAVICRTTWNNFLMDFGRYYAQFQATVKSLATLDCLYSLATLAKQNKYVRPNFVRENEASQIHIKDGRHPVLESLLGVNFVPNDTELHANSEYCQIVTGPNMGGKSCYIRQVALITLMAQVGSFVPASSATLHAVDGIYTRMGASDSIQHGTSTFYEELSEASNILHNCSSRSLVIIDELGRGTSTHDGVAIAYATLHYLLKEKKCMVIFVTHYPKILNILREFEGSVGAYHVSYLATRKLLEVADRQMVINNTETKDLGEITFLYKLVAGASDRSFGLNVALLAQLPSSCIERASVMAAKLQQELSEREKNKFCRLMDVPRESSPKELCAQPYQGLAEACHRILFNVTSAQSNDELTDTLSSLREAREIALKAIKGWGRVGMGLSRFTAPRPGLQIGAAGNGFRACSLRRLRHRVCGGNPMGASALGGCGSRSLFYLAPNHGSPLALRTRGRALRCQGNDSLAYVDGPLEGTNGSVVDNTEDEANSSGLDEEKGDDDAENLRDLLQKARKELEVARLNSTMFEEKAQRISESAIALKDRADKAQSDVSSAVTTIQEIISKEADAKEAVRTATMALSMAEARLQLASEALDAKRGSVGPMEVSIDDVEEEALASAQEEIKECQESLSKCEEELRRIQEKKMELQKEVDRLTELAERALLDASKAEEDVANIMVLAEQAVALEMEAAQRANDAELALQKAEKAISSVDAVVELPAPAEEQVSDEEDNVSEVYDYSSDAIDDIPERDEVSNVERLIVGDLAVEGIEQLESSREMSDDESTDKLLVEPQKEAEPDIDKSKQGKKQEIERKESQPSNAPKASLKRSSRFFPASFFSSKADGEFTPTSVFKGLMKSTRKHAPKLVVGIVLLGAGAFFLNRAEKSSQLFQQQEVTTSIEEVTSTAKPIVREMRKIPQRVKKLIELLPHQEVNEEEASLFDILYLLLASVVFVPLFQKIPGGSPVLGYLAAGVLIGPYGLSIIRHVHGTKAIAEFGVVFLLFNIGLEDISAYHFLPAAFCGKAKLNEEVLATTAAVGMIAHRFAVLPGPAAIVIGSGLALSSTAVVLQVLQERGESTSRHGRATFSVLLFQDLAVVVLLILIPLISPNSSKGGVGFQAIAEAMGMAAVKAIAAITAIIAGGRLLLRPIYKQIAENRNAEIFSANTLLVIFGTSLLTARAGLSMALGAFLAGLLLAETEFSLQVESDIAPYRGLLLGLFFMTIFFLVQHRGFYYLLWNDDKSLILPVGMSIDPKLLLSNFPAISVILGLLIIGKTMLVTFIGRVFGISTIAAVRVGLLLAPGGEFAFVAFGEAVNQGLLSPQLSSLLFLVVGISMALTPWLAAGGQFLASKFEQHDVRSLLPVESETDDLQDHIIILGFGRVGQIIAQLLSERLIPFVALDVRSDRVAVGRALDLPVYFGDAGSREVLHKVGAERACAAAITLDTPGANYRAVWALSKYFPNVKTFVRAHDVDHGVNLEKAGATAVVPETLEPSLQLAAAVLAQAKLPMSEIAATVNEFRNRHLSELTELCATSGSSLGYGYSRVMSISKSKTVTSDDESETVDGALAI

SEQ ID NO: 18889 - protein, 426 aa, Thermoplasma acidophilum
MQWQAMGSKDLFQRGSSLFPMGVNSPVRYFKDYPFYVDNASGSRIYDVDGNEYIDYCLAYGPSILGHADPDVVRAVRDQAEKGLIYGAPSEAEIRLGDIIRRSSKNIEMMRFTNSGTEATMHAIRLARAYTGRSIIVKMEGGFHGAHDYSLIRSGSGTLTFGSPSSPGVPEEVARTVVVGRYNDEANIRNIFSQYGSRIAAVITEPIMGNAGVITPEPGFLEFLRDITQKNGSLLIFDEVITGYRFAFSPYQDIIGIRPDLTTMGKIIGGGMPIGLFGGSADIMKKVSPSGDVYQSGTFSGNPVTMAAGFAALKKLQGMDYASLVRRTEKLMNGIDDILAKRKIRHVVNGYRSMFQFFFAESAKNYDEVMKADRDLYFRIFKRLMNHGVYVPPSQFETNFVSFAHSDDDISKTIEAFDLSVGEAAK

SEQ ID NO: 18890 - protein, 166 aa, Arabidopsis thaliana
MGLVFLTVFMAVMSSTMVSAQSSCTNALISMSPCLNYITGNSTSPNQQCCNQLSRVVQSSPDCLCQVLNGGGSQLGINVNQTQALGLPRACNVQTPPVSRCNTGGGGGGSTSDSPAESPNSSGPGNGSKTVPVGEGDGPPSSDGSSIKFSFPLIAFFSAVSYMAIF

SEQ ID NO: 18891 - protein, 170 aa, Zea mays
HGKKVVCGTPSGALLLYSWGYFNDCSDRFLGHTQSVDTMLKLDEDTLVSGSSDGVIRLVGILPNRIKQPLAEHSEYPIEALALSNDKKYLGSISHDKMLKLWDMEELLSGPQVANGDEPAEAGSDDNDDDSDDDVMDVDMAATSSKGSRSKKAGKGQSSSRPASDFFADL

SEQ ID NO: 18892 - protein, 275 aa, Triticum aestivum
  misc_feature (62)..(62): Xaa can be any naturally occurring amino acid
  unsure (1)..(275): unsure at all Xaa locations
YLLAGACPNPVNVRPRGLSGAGCAIWGGGKALLAPTRGKLGGRQTRGSQDRGAMMDRLISEXGGRRLQDDEIIDVLVMYLNAGHESSGHITMWATVFLQENPDILAKAKAEQEAIMRSIPPGQKGLTLRDFRKMEYLSQVVDETLRFVNISFVSFRQATRDVFVNGYLIPKGWKVQLWYRSVHMDPQVYPDPKKFDPSRWEGPPPRAGTFLPFGLGTRLCPGNDLAKLEISVFLHHFLLGYKLTRKNPNCRVRYLPHPRPVDNCLAKITRVSSSH

SEQ ID NO: 18893 - protein, 622 aa, Glycine max
SSLFGFTVITDTKGEEYFTYKWNSPEKVRFQITWDGFEKKFVLDADGKQWNRTQFEPFDDCEKYNFCGSFAVCDTGNSPFCSCMEGFEPMHWEEWNNRNWTRGCGRRTPLKAEAERSANNSSSGADREVSVGEDGFLEQRCTKFPDFARLENFVGDADCQRYCLQNTSCTAYSYTIGIGCMIWYGELVDVQHSQNNLGSLLHIRLADADLGDGGKKTKIWIILAVVVGLICIGIVVLLVWRFKRKPKVSSASGFNNNSEIPAFDLTRSTDLSEISGELGLEGNQLSGAELPLFHFSCILAATNNFSDENKLGQGGFGPVYKGKIPGGEEVAVKRLSRKSSQGLEEFKNEMVLIAKLQHRNLVRLLGCCIQGEEKILVYEYLPNKSLDCFLFDPVKQTQLDWAKRFEIIEGIARGLLYLHRDSRLRIIHRDLKASNILLDESMNPKISDFGLARIFGGNQNEANTNRVVGTYGYMSPEYAMEGLFSIKSDVYSFGVLLLEIMSGRKNTSFRDTDDSSLIGYAWHLWSEQRVMELVDPSLGDSIPKTKALRFIQIGMLCVQDSASRRPNMSSVLLMLGSESTALPLPKQPLLTTSMRILDDGESYSEGLDVSNDLTVSMVTTGR

SEQ ID NO: 18894 - protein, 901 aa, Kluyveromyces lactis NRRL Y-1140
MGSGTARRPSLSTSTSNDMMVDEPHGVPRLSRRLTGFLPQEIKSINTMIPLQSREIWKKHGVKKFETPDEFQSKFIQHVETTLARSLYNCDDLAAYQATSQSVRDNLVIDWNKSQQRQTARGSKRVYYLSLEFLMGRALDNALINSQDGSEESGVEKREKIKGAIDELGFKLEDLLEQEPDAALGNGGLGRLAACFIDSMATGDYPAWGYGLRYQYGIFAQKIIDGYQVETPDYWLNFANPWEIERSEIQVPINFYGYVDRSDNNGDGSTLCASKWIGGERVIAVPYDMPIPGFKTENVNNLRMWTARPTTEFDFAKFNSGDYKNSVEQQQRAESITAVLYPNDNFQEGKELRLKQQYFWCAASLHDIVRRFKKAKHSWEDFPNQVAIQLNDTHPTLAIVELQRILVDLEHLDWHKAWDIVTKTFAYTNHTVMQEALEKWPIGLFGHLLPRHLEIIYDINWFFLKHVESKFPRDVDLLSRVSIIEEASQERQIRMAFLAIVGSHKVNGVAELHSELIKTTIFQDFVKIYGPGKFTNVTNGITPRRWLKQANPKLGELISKAIGDPQDDYLLNMSKLTELAKFAEDEDFQSQWNDVKQFNKQRLADLIEKLYDGEDVIQRDNIRNTLFDIQVKRIHEYKRQQMNIFGCIYRYLSIKKLLSQGVPISEVEKKYPRKVSIFGGKSAPGYYMAKLIIKLINSVSDVVNHDKEINNIFKVVFIPDYNVSKAEIIIPASDLSEHISTAGTEASGTSNMKFVMNGGLIIGTVDGANVEITREIGEDNIFLFGNLAENVEELRYQHQYHGEPLPQELEEVFQVIEQGTFDGDFKPLVESIRHHGDYYLVSDDFKSYLQTQSLVDEVYHKNKKEWLKKSILSVANVGFFSSDRCIQEYADEIWNVEPLTN

SEQ ID NO: 18895 - protein, 535 aa, Cryptococcus neoformans var. neoformans B-3501A
MPDPAPFWLCHECGAQMRPVTVDGTPHCASCNGEFIEILDPEVNPDPDYELPPPPPTRPGQQTPSRFDPHFLSNFPPPPQSEGSSSPARQRDTNNTGNFLSSLFSMLGTGSRQGSEETPRRPPPSFHGEPSASQRNGQSQNTDRPGMRTYAFNFGNARGSVTIGSFGSNLGRQGYRMNNDPTSPSGNLFNDPDPFRADPFDARFRPPGDGNRDINGDMPLPLGANEALQLIAALLDGNPPPNMGNLGDFATSDADFMRILQETFMEAAGPQGPVPANETVIEGLPRFTFDSGSLAKSQFRDCPVCKDDFEIGNEVMLIPCGHIYHPDCLVPWLRQNGTCPVCRFSLVSEDEQPNNQRTTNVGTEHTRNAEEERPATPTIPAAVSNFFRNLFGGSESQPPTPRAAAGGGHGSNASQDPHSSVNVVSESTISADASSRHSPTIHGATRREQVQQCDEVASEGSSNDSLVRVYPEHSSGETHGDDATNGEAGRIAEQEQQVASRDRLADRVNRDFNERWQRLRREREEDDTVYHPDLD

SEQ ID NO: 18896 - protein, 272 aa, Shewanella sp. MR-4
MSQQKICFIGAGNMTRSIISGLIRSGYPAALVQATNPSQGKLDALAADFGVRVSQDNVSAAQDADVIVLSVKPQLMEQVCQALQGIDMSNKLVITIAAGIKAERYSQYLAQPITLVRTMPNTPMQIGVGMTGLYAPQPLSDAQQAITERLMSSGGEIVWVNEESEINQVIALAGSSPAYFFLLMESMIDAGKQMGMDEAKARSLVQQAALGAAMMAKQNPELTLGNLRENVTSKGGTTAQAIATFEAADLRGVVKNAMENCIKRAEEMANTF

SEQ ID NO: 18897 - protein, 195 aa, Triticum aestivum
  misc_feature (16)..(16): Xaa can be any naturally occurring amino acid
  misc_feature (52)..(52): Xaa can be any naturally occurring amino acid
  misc_feature (63)..(63): Xaa can be any naturally occurring amino acid
  misc_feature (90)..(90): Xaa can be any naturally occurring amino acid
  misc_feature (101)..(101): Xaa can be any naturally occurring amino acid
  misc_feature (123)..(123): Xaa can be any naturally occurring amino acid
  misc_feature (125)..(125): Xaa can be any naturally occurring amino acid
  misc_feature (128)..(128): Xaa can be any naturally occurring amino acid
  unsure (1)..(195): unsure at all Xaa locations
PEILLDGDHGIERTLXVAEKVWSEVFFYLAENNVLFEGILLKPSMVTPGADXKEKVLQNHCEXHPPQCLRRRLHLLSPGHFLSGGHPDLXATMNLNAMNHXPNPWTVLLPTPRASQNSGAEDXAXEPXNIQARKRPAVPPQAIPLRTPYTGKGTTSKFQKGNYGAHGRYYKSLIGLFQIMGKTYTVNTLLFDKPG

SEQ ID NO: 18898 - protein, 410 aa, Salmonella typhimurium LT2
MAKVSLEKDKIKFLLVEGVHQKALESLRAAGYTNIEYHKGALDAEQLKASIRDAHFIGLRSRTHLTEEVINAAEKLVAIGCFCIGTNQVDLNAAAKRGIPVFNAPFSNTRSVAELVIGELLLLLRGVPEANAKAHRGVWNKLAAGSFEARGKKLGIIGYGHIGTQLGILAESLGMHVYFYDIENKLPLGNATQVQHLSELLNMSDVVSLHVPENASTKNMMGAKEIALMKPGSLLINAARGTVVDIPALCDALATKHLAGAAIDVFPTEPATNSDPFTSPLCEFDNVILTPHIGGSTQEAQENIGLEVAGKLIKYSDNGSTLSAVNFPEVSLPLHGGRRLMHIHENRPGVLTALNQIFAEQGVNIAAQYLQTSARMGYVVIDIEADGDVAEKALLAMKAIPGTIRARLLY

SEQ ID NO: 18899 - protein, 133 aa, Brassica napus
TFFAASETLELLENVGAVSDFSGKARLFLVLPVAVLDAFFIIWIFKSLSATFKKLQTRRLLVKLDVYRKFTNALAVAILVSVGWICYELYFKSKDVYNEHWQNAWIIPAFWQLLSFSLLIVICSLWAPSQNST

SEQ ID NO: 18900 - protein, 514 aa, Salmonella typhimurium LT2
MSVSKKPMVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVIRAEGQADAAMEDGDTLIFMNFRADRAREITRAFVNADFDGFARKKVVNLNFVMLTEYAADIKTAVAYPPASLANTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIEQVTKAVESVGGQLLITADHGNAEQMRDPATGQAHTAHTNLPVPLIYVGEKNVKAVEGGKLSDIAPTMLSLMGMEIPQEMTGKPLFIVE

SEQ ID NO: 18901 - protein, 118 aa, Witheringia maculata
NWSGRLLHCIPNYTFVKIEIGEKSDILDKSWPQLENTKTDGLKRQTFWERQYKKHGTCCKNKYTKEAYFNLAINLKDRFDILKILSDQGIIPGKKYVVQKVHDAIETVTRQPPKLTCT

SEQ ID NO: 18902 - protein, 341 aa, Salmonella typhimurium LT2
MKALSKLKAEEGIWMTDVPEPEVGHNDLLIKIRKTAICGTDVHIYNWDDWSQKTIPVPMVVGHEYVGEVVGIGQEVKGFKIGDRVSGEGHITCGHCRNCRGGRTHLCRNTTGVGVNRPGCFAEYLVIPAFNAFKIPDNISDDLASIFDPFGNAVHTALSFDLVGEDVLVSGAGPIGVMAAAVAKHVGARHVVITDVNEYRLELARKMGVTRAVNVAKESLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 18903 - protein, 1053 aa, Zea mays
QTRRKKGNIRRHPVMRPSPPLLLFVLLHFALLSTIAAADGNGNGNGNGDLRGDAMALLALKAALGCRPGALRSWSEGNAGSVCAWTGVRCAAGRVVAVDIANMNVSDGTPVSARVTGLGALETISLAGNGIVGAVAASALPALRHVNVSGNQLGGGLDDGWDFASLPGLEVLDAYDNNFSAPLPLGVAALPRLRYLDLGGNYFTGEIPAAYGAMPAVEYLSLNGNNLQGRIPLELGNLTTLRELYLGYYNVFDGGIPPALGRLRSLTVLDASNCGLTGRIPAELGALASLGTLFLHTNQLSGPIPPELGNLTSLAALDLSNNALTGEVPRSLASLTSLKLLNLFLNRLHGPVPDFIAALPRLETVQLFMNNLTGRVPAGLGASAALRLVDLSSNRLTGFIPETLCASGQLHTAILMNNFLFGPIPGSLGTCTSLTRVRLGQNYLNGSIPAGLLYLPRLSLLELHNNLLSGAVPSNPNPSASSLQLQLAQLNLSNNLLAGPLPSTLANLTALQTLLASNNRIGGAVPPEVGELRRLVKLDLSGNELSGPIPGAVGQCGELTYLDLSRNNLSGAIPEAIAGVRVLNYLNLSRNALEDAIPTAIGAMSSLTAADFSYNDLSGQLPDTGQLGYMNATAFAGNPRLCGSVVSRPCNYTGGGGVAGAATTRLGGLKLVLALGLLACSVVFAVAAVLRARSFRVDVGAGRWRLTAFHKVDFGVAEVIECMKDGNVVGRGGAGVVYAGRTRSGGAIAVKRLQAQGGAGAQQGDDDRGFRAEVRTLGSIRHRNIVRLLAFCTNREANVLVYEYMGGGSLGVVLHGKGGAFLAWERRYRIALEAARGLCYLHHDCTPMIVHRDVKSNNILLGDNLEARVADFGLAKFLRCGATSESMSAVAGSYGYIAPEYAYTLRVDEKSDVYSYGVVLLELITGRRPVGDFGEGVDIVQWAKRATAGRREAVPGIVDRRLVGGAPADEVAHLFFVSMLCVQDNSVERPTMREVVQMLAELPRHESSPSTSSSSSSSSAVEPPPPQAGEESSPDDGKEPPANCYKLFPDLLA

SEQ ID NO: 18904 - protein, 249 aa, Candida glabrata CBS 138
MSNLEASKVYELIVSNVINEVREDFESAGIDEQTLQDLKRVWQEKLTETKVTHFSWDPVTDAVPATNETNQQETSTTETNGLQLPGGAVISAPSTGNDMSPQDENTNNADDGDATAGMLAGGDDDLNNNENNVSDNNVQVKQEGDVKFEMTIENADTSDLESKNKDHKEAKRSALLDADEVGSELDDSDDNYLISEGEDEGPDENIILCLYDKVTRTKARWKCTLKDGIATVNRKDYSFQKAQVEAEWV

SEQ ID NO: 18905 - protein, 304 aa, Sulfolobus tokodaii str. 7
MLAIRLARGYTKREKILKFDGNYHGAHDYALINAGSAVSEFNVIISSGIPTSIINTVIVCKYNDLDCVEKHLRTEEIAGVIVEPVMGNMGVILPEQDFLNGLRELTKTYNSVLIFDEVITGFRLGLSGAQGYFKVIPDLTTLGKIIGGGLPIGAVTGKKEIMSNLTPEGKVFNAGTFNANPLTMAAGIATIEVLETTNAYDIANKASKEIAEELDNSLSKKNFKYTINRIQSMFQFFIGISKVTNADDARLANKDLYVKIHEKLLKLGVFIPPSQFETIFTSSSHSDEIVNLTIEAIHKVVSEI

SEQ ID NO: 18906 - protein, 391 aa, Francisella tularensis subsp. holarctica
MHNESLISIFVFVMLGILVVTIVLKKLKQPYVVAYLLTGILLGPYGLRLIQDQENLARLGEIGVILLLFFAGMEVSPRKFAENWQVPTIGTMLQMLITSLIVSIIGVALGWSIAKILLFGAVISLSSTAVVLKLLNDSGSMKTRLGQNVLGILLIQDLAVVPMLILVRLIGGEELSISQIVTQILGGILVISIAAIMAVKKNIKISFISVLGKDEEMRVFAALVICFGMAALTESLELSSALGAFVGGIIVSTLEETEWVGHSLSTVKTIFMALFFISVGMLIDLKLFWNHIFLFMALLLLIYSLNTTINALIFKALRQRTEEALIGGAMLSQIGEFSFVLISMGFASGILSLTIYHYCITLISLSLLFSPLWISGVNLYIKKYIKKKPQN

SEQ ID NO: 18907 - protein, 461 aa, Burkholderia xenovorans LB400
MNSAQQQDGLKRGLKNRHIQLIALGGAIGTGLFLGSASVLQAAGPSMILGYAIGGVIAFMIMRQLGEMVAQEPVAGSFSHFAYKYWGDFPGFLSGWNYWVLYVLVSMAELTAVGTYVHYWWPGVPTWVSALVCFAAINAINLANVKAYGETEFWFAIIKVAAVIGMIVFGGYLLISGHGGPQASISNLWAHGGFFPHGFHGLFMMLAVIMFSFGGLELIGITAAEADEPQKSIPKAVNQVIYRILIFYICSLTVLLSLYPWNEVAAGGSPFVMIFSQIGSTLTANVLNVVVLTAALSVYNSGVYANSRMLYGLAEQGNAPRALMKVDRRGVPYMAIGLSALATFTCVIVNYLIPAEALGLLMALVVAALVLNWALISITHLKSRKAMVAAGETLVFKSFWFPVSNWICLAFMALILVILAMTPGLSVSVWLVPAWLVVMWAGYVFKRRRAAVQGGARVVGR

SEQ ID NO: 18908 - protein, 507 aa, Burkholderia xenovorans LB400
MVTTSTDETVAHAGDNKAVSTEQGVPAAVRLVPVVLAGGAGSRLWPMSREQYPKQLIDVLGSESLLQATVQRMKGFNAQGRLVSTPIVVCGNEHRFVTSEQLRERGVEARIVVEPARRDTAPALTLAATTACADGEDAIVLVMPADHAIVDVAAFQAAIALAAQHAERGAIVALGVPPTRADTGFGYIKLGDEISGEAHRIERFVEKPAAEIAAQYVASGEYWWNSGIFVLRASVWLATLKRLQPAMYDACLQAQAQGYSDASFFRPGADAFSSSPADSIDYAVMEHLGSQQGIAEGVVVPLSAGWSDLGSWDAVWDALEKDADGNACRGRVVFEGATSSFAHSEKRLIACVGVTNVVVVETDDAVLVADRSRVQEVKIVVSRMRALQAPEAEVHRKVRRPWGYYDSVDHGERFQVKRIVVNPGGRLSLQRHHHRAEHWIVVSGTALVTRGDEEFLLSENQSTFIPLGVTHRLENPGKLPLELIEVQSGSYLGEDDIVRFDDTYGRA

SEQ ID NO: 18909 - protein, 453 aa, Ralstonia metallidurans CH34
MPPGLPRLASLIADAPPDAQDNPEIPRFRCRQRPAACPDIANTAVKPIQKSHKLQNVCYDIRGPVLEKAKQMEEEGHKIIKLNIGNLAVFGFDAPEEIQQDMMRNLPNSAGYSDSKGIFAARKAIMHYTQEKKIQGVGLDDIYVGNGASELIVMAMNALLNSGDEMLVPAPDYPLWTAAVSLSGGTPVHYVCDEANEWMPDLDDIRRKITPNTRGIVIINPNNPTGALYSDELLKEIVAIAREHGLIIFADEIYDKVLYDGNTHTSIGSLSTDVLTVTFNGLSKNYRSCGYRAGWMVVSGDKRPALDYIEGLNMLSSMRLCANVPGQWAIQTALGGYQSINDLVTEGGRLRRQRDLAYELITKIPGVTCVKPKAALYLFPKLDLSMYPIQDDQEFIYELLQESKVLLVQGTGFNWGAPDHFRIVFLPHEEDLREAITRVGRFLESYRKRHGTA

SEQ ID NO: 18910 - protein, 456 aa, Salmonella enterica subsp. enterica serovar Typhi
MESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKMFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTNGSPFVLTFQHMGITFAASILNFVVLTASLSAINSDVFGVGRMLHGMAEQGSAPKVFAKTSRRGIPWVTVLVMTIALLFAVYLNYIMPENVFLVIASLVTFATVWVWIMILLSQIAFRRRLPPEEVKALKFKVPGGVVTTIAGLIFLVFIIALIGYHPNTRISLYVGFAWIVLLLIGWIFKRRRDRQLAQA

SEQ ID NO: 18911 - protein, 269 aa, Anaplasma phagocytophilum HZ
MKITKYRTKKSLGQCFILDPAIAEKIVSYAGCLEQYNVIEVGPGLGIMTQSILNKEVRRLTAIEKDRRLSNIHSKLKEAHAEYDCIFEDILDVNIEQLLSQSPLKMISNLPYNISVILLLKLLPYIHRFEKLILMFQKEVADRIVAQPNTKSYSILSILVQLLCDVRKVEDFPPEIFSPSPKVYSSVIEITPLLSPRFSVDNSYFAQVLKKLFHCRRKTIRNSLKSCIKDADALFIGCNIDPNARAESLTIEQLCSLTNALKARNINII

SEQ ID NO: 18912 - protein, 229 aa, Zea mays
  misc_feature (172)..(172): Xaa can be any naturally occurring amino acid
  unsure (1)..(229): unsure at all Xaa locations
MASGNVSTVYISVIDDVVAKVREDFITYGVGDAVLNELQALWEMKMLHCGAISGNIDRNRAPPASAGGAPGAGATPPVHDLNVPYEATSEEYATPTADMLFPPTPLQTPIQTPLPGIDTGMYNIPTGPSDYAPSPISDMRNGMGMNGSDPKTGRPSPYMQPPSPWMNQRPLXVDVNVAYEESREDPDRMMQPQPLTKDFLMMSSGKRKRDEYPGQLPSGSFVPQQDGCA

SEQ ID NO: 18913 - protein, 401 aa, Guillardia theta
MQEDMEYNIRFVGSYILDKTLGVGATGKVKLAKHSRTKEKVGVKIIKKDLFYDKPSLRLKIQREISVMKLMFHPHVIKIYDVLEDSKYLFLIIEYASKGELFNYLVEKRKLENREALKFFHEIISGLEYCHKHRICHRDLKLENILLDMKLQIKIADFGMASLSIPNIMLKTFCGSPHYASPEVVSNEPYNGIKADIWSCGIILYALVVGKLPYDEENDNMRKLFNKIRFEPPRIPRIIHPDCRDLIRALLTINPQKRITIDKIKKHPWYKSSPLPESCRISIQNLSFASVQNPISNPDPEIISFLLPLQLVKDKKTLCGILSTKKPSFLRVLYRQLEWRKMKMDSVRSNLINEANFKRKKLFKQGKLGNITGLKYWKNLKCKFLSINIKSFVRTGIYIYF

SEQ ID NO: 18914 - protein, 3403 aa, Oryza sativa (indica cultivar-group)
MVYFLMFLLLLSIPLCKTDDQLTLGKPIFPSEMLISKGGIFALGFFSPANFSNSLYVGVWFHNIPQRTVVWVANRDNPITTPSSATLAITNSSGMVLSDSQGHILWTTKISVTGASAVLLDTGNFVLRLPNGTDIWQSFDHPTDTILAGMMFLMSYKSEIVGRLTAWRSHDDPSTGDFSFSLDPSSDLQGMTWNGTKPYCRNGVRTSVTVSGAQYPSNSSLFMYQTLIDSGNKLYYSYTVSDSSIYTRLTLDSTGTMMFLSWDNSSSSWMLIFQRPAAGSCEVYGSCGPFGYCDFTGAVPACRCLDGFEPVDPSISQSGCRRKEELRCGEGGHRFVSLPDMKVPDKFLQIRNRSFDQCAAECSSNCSCKAYAYANLSSGGTMADPSRCLVWTGELVDSEKKASLGENLYLRLAEPPVGKKNRLLKIVVPITVCMLLLTCIVLTWICKHRGKQNKEIQKRLMLEYPGTSNELGGENVKFPFISFGDIVAATDNFCESNLLGRGGFGKVYKRFPIYIDDNMKGILEGGTEVAVKRLNEGSGQGIEEFRNEVVLIAKLQHRNLVRLLGCCIHEDEKLLIYEYLPNKSLDAFLFDATRKYVLDWPTRFKIIKGIAKGLLYLHQDSRLTIIHRDLKASNILLDTEMNPKISDFGIARIFHGNQQQANTTRVVGTYGYMSPEYVLGGAFSVKSDTYSFGVLLLEIVSGLKISSSKLTPNFFSLTAYAWRLWKDGNATELLDKFFVDSYPLHEAFSDVIYDFKSLMENSGVCCVRILAGYLDHEGDAAAAPPRLDCTTDDDFSSAVSPPHNDVAQFTALAELIPEHARFNEDGMYHAIDIYLKTVVQVLYHEQRRLRAPSQPPSTAPSFCQSDDRLTPAKPLIFPGGDKLISDGGVFAVGFFSLTTTNSTPSLLYLGIWYNNIPERTYVWVANRDNPITTHTARLAVTNTSGLVLSDSKGTTANTVTIGGGGATAVLQNTGNFVLRLPDHPTDTILPGLPGFKLWTNYKNHEAVRVVAWRVRRDPSTCEFSLSGDLDQWGLQIVIWHGASPSWRSGVWNGATATGLTRYIWSQIVDNGEEIYAIYNAADGILTHWKLDYTGNVSFRAWNNVSSTWTSPFERPGHGCLHYGACGPFGYCDITGSFQECKCLDGFEPADGFSLNSSRGCRRKEELRCGGQDHFFTLPGMKVPDKFLYIRNRTFEECADECDRNCSCTAYAYANLRTILTTGDPSRCLVWMGELLDSEKAGAVGENLYLRLAGSPAVNNKNIVKIVLPAIACLLILTACSCVVLCKCESRGIRRNKEVLKKTELGYLSAFHDSWDQNLEFPDISYEDLTSATNGFHETNMLGKGGFGKGTLEDGMEVAVKRLNKDSEQGVEQFRNEVVLIAKLQHKNLVRLLGCCIHGDEKLLIYEYLPNKSLDKFLFDHAMKSVIDWQTRFNIIKGVARGLLYLHQDSRMMIIHRDLKTSNILLDAEMNPKISDFGMARIFGNSEQQVSTRRVVGTYGYMAPEYAMEGIFSVKSDTYSFGVLLLEIAWNLWKDGMAEAFVDKMVLESCLLNEVLQCIHIGLLSLKVHLRLAEGGLLIAFWEDVKGIVCKIADLFLRGADKSRSGVTSLAHRTKFTVQKRVVYGLVAKIKGANCSRFIATGEPRTRPYEIYQIMACLPVFISLLFLISSCKGDDQLTQANRLISPGDVLISKGRVFALGFFSPTASNQSFFLGIWYHNISESERTYVWVANRDNPITTPSFATLAISNSSNLVLSDSGNHTLWTTNVTATGGDGAYAALLDSGNLVLRLPNGTTIWQSFDHPTDTLLMGMRFLVSYKAQVAMRCIAWKGPDDPSTGDFSISGDPSSNLQIFLWNGTRPYIRFIGFGPSSMWSSVFSFSTSLIYETSVSTDDEFYIIYTTSDGSPYKRLQLDYTGTLKFLAWNDSASSWTVVVQRPSPTIVCDPYASCGPFGYCDATAAIPRCQCLDGFEPDGSNSSSRGCRRKQQLRCRGRDDRFVTMAGMKVPDKFLHVRNRSFDECAAECSRNCSCTAYAYANLTGADQARCLLWSGELADTGRANIGENLYLRLADSTVNKKKSDILKIELPVITSLLILMCICLAWICKSRGIHRSKEIQKKHRLQHLKDSSELENDNLELPFICLEDIVTATNNFSDHNMLGKGGFGKVYKGVLEGGKEVAVKRLSKGSQQGVEEFRNEVVLIAKLQHRNLVRLISYCIHEDEKLLIYEYLPNKSLDTFLFDAKRKSVLDWTTRFMIIKGIARGLLYLHQDSRLTIIHRDLKASNILLDTNMSPKISDFGMARIFEGNKQQENTTRVVGTYGYMSPEYALEGSFSVKSDTYSFGVLLLELAWSLWKDGNAMDLVDSSIRESCLLHEVLRCIQIALSCVQDDPTARPLMSSIVFMLENETAALPTPKEPAYLTAMVYGTKDTRENKERSVNNHCIGKKQSAYSKARRRRLIHGKPQAKAKPAHHHQPGSNTLNHNPHSTVEIWINPINQWRTGTLMDLRPEEIRTICVNGTNPHPSMGAPPDGKQPRRLRRCGIQDSPTDRSCKLSSMRRQIRFHPAAAAATAAAAATATATAAISDESEVGIEGLMGTAFATVFVLVFLISLCKSDDQLTPAKPLHPGDMLISDGGVFALGFFSPTKSNATLYVGIWYHKIPNRTVVWVANRDNPITAPSSAMLFISNSSDLVLSESGGHTLWEARNNITTGGSGATVVLLNSGNLVLRSPNHTILWQSFDHLTDTILPGMKLLLKYNGQVAQRIVSWKGPDDPSTGNFSLSGDPNSDFQVLVWNGTSPYWRSGAWNGALVSATFQSNTSSVTYQTIINKGNEIYMMYSVSDDSPSMRLMLDYTGTIKMLIWNSNLFAWSVLFSNPSYTCERYASCGPFGYCDAAEAFPTCKCLDGFKPDGLNISRGCVRKEQMKCSYGDSFLTLPGMKTPDKFLYIRNRSLDECMEECRHNCSCTAYAYANLSTASMMGDTSRCLVWMGELLDLAKVTGGGENLYLRLPSPTAVKKETDVVKIVLPVVASLLILTCICLVWICKSRGKQRSKEIQNKIMVQYLSASNELGAEDVDFPFIGFEEVVIATNNFSSYNMLGKGGFGKVYKGILEGGKEVAVKRLSKGSGQGIEEFRNEVVLIARLQHRNLVKLVGCCIHEDEKLLIYEYLPNKSLDAFLFDATRKTVLDWPNRFKIIKGVARGLLYLHQDSRLTIIHRDLKAGNILLDAEMSPKISDFGMARIFGGNQQQANTTRVVGTYGYMSPEYAMEGIFSVKSDIYSFGILLLEIISGFRISSPHLIMGFPNLIAYSWSLWKDGNARDLVDSSVVESCPLHEVLRCIHIALLCIQDHPDDRPLMSSVVFMLENNTAPLPQPKQPIFFVHKKRATEYARENMENSVNGVSITALEGR

SEQ ID NO: 18915 - protein, 438 aa, Bacillus anthracis str. 'Ames Ancestor'
MHHDEKNKIGLTVALSIVVGTIIGSGVFMKPGSVLDYSGSSNMAILAWVIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISENQSIGMAILATLFAYDGWILLASIGGEMKNPTKLLPKAMTVGILIVTAAYVLINLALLNVLPATQIVELGENATATAAGMLLGEYGGKIISIGIIVSIFGCLNGKILTFPRIPMSMAERGQLPFAKFIAKESPRFKTPANAITVEIILGIILMIISDPNKLSEISVFIIYIFYVMTFIGVFILRKRNKNKERAYSVPLFPIVPIVAILGSLFVIGSAIINDPLSCFLSIGIVFTGLPVYWYLNKKNKTEVS

SEQ ID NO: 18916 - protein, 468 aa, Yersinia pseudotuberculosis (type O:1b)
MLLPVIMAGGAGSRLWPLSRALYPKQFLALTSDLTMLQETLLRLDGLPHLAPLVICNEEHRFIIAEQLRQKNLVHSGIVLEPVGRNTAPAIALSALRATMSGDDPLLLVLAADHVIQDKLAFIRAVQRAEPLAEAGKLVTFGIVPKSPETGYGYIRQGKQVVDGAYQVAAFVEKPDLITAERYLASGDYYWNSGMFVFKASRYLQELDLHRPDILAACKQAIAGQHTDLDFIRLNEEAFSSCPDESIDYAVMEKTSDAVVVPLDAQWNDVGCWSALWEINTKDDHGNVIRGDVLIEDTNNSYVYSQNRLIATVGINDLVIVETKDAILVAHKDKVQNVKGIVGQLKLESRCEYLQHREVYRPWGSHDAIAEGVRYHVQHVTVKPGQRIATQIHYHRAEHWIVVSGIAKVHYGKETYLVNENESTYIPVGIAHSIENPGQIPLEIIEVHTGNYISEDDVERIDDLGVGY

SEQ ID NO: 18917 - protein, 745 aa, Oryza sativa (indica cultivar-group)
MKAPRGVCDDYAKCGAFGLCNEDTASTLFCSCMAGFSPVSPSRWSMRDTSGGCRRNAPLECGNGSTTDGFVTVRGVKLPDTDNATVDTGATLDECRARCLANCSCVAYAAADISGRGCVMWIGDMVDVRYVDKGQDLHVRLAKSELVNNKKRTVVKIMLPLTAACLLLLMSIFLVWLYKCRVLSGKRHQNKVVQKRGILGYLSASNELGDENLELPFVSFGEIAAATNNFSDDNMLGQGGFGKVYKGMLDDGKEVAIKRLSKGSGQGAEEFRNEAVLIAKLQHRNLVRLLDHANKYVLDWPTRFKIIKGVARGLLYLHQDSRLTVIHRDLKPSNILLDVDMSPKISDFGMARIFGGNQHEANTNRVVGTYGYMSPEYAMDGAFSVKSDTYSFGVILLEIVSCLKISLPRLTDFPNLLAYAWNLWKNDRAMDLMDSSISKSCSPTEVLLCIQIGLLCVQDNPNNRPLMSSVVSMLENETTTLSAPIQPVYFAHRAFEGRQTGENSISLLEGRIKLGLPPIGGKPLPCLLDFVPTNLGMLGGNKEVAIKRLSKHSGQGVEEFRNEVVLIAKLQHKNLVRLLGCCIHGEEKLLIYEYLPNKSLDYFLFGIFSVKSDTYSFGVLVLELISGSKISSPHLIMGFPNLIACAWSLWKNGKAEDLVDSIILQIYSLNEFLLCIHVGLLCVQEDPNARPLMSSVVAMLENEATTLPTPKQPAYFVPRNCMAGGAREDANKSVNSISLTTLQGR

SEQ ID NO: 18918 - protein, 464 aa, Escherichia coli O157:H7 EDL933
MPDAKKQGQSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAGLNVLFILLTLWLVPETKHVSLEHIERNLMKGRKLREIGAHD

SEQ ID NO: 18919 - protein, 277 aa, Thermoanaerobacter tengcongensis MB4
MIQWYPGHMAKAKKEIISNLKLVDVVYEIVDARIPRSSRNPDFDEITKRKKKIMLLNKEDLADERITDLWIKHFKEKGIEAVKVNAITGKGFKELEEKTKEVCKDILEAKVKKGLTPRLRGMILGIPNVGKSTFINTLIGRKKAKTGDKPGVTKSLHWIRTPYLDLLDTPGVLWPKFEDKTTGFMLAITGAIKDEILEMEEVALFLVSILKNRYPDYLINRYKLDKIWEEEIKIIEDIGKKRGCLVSGGEVDFVKASTVLLEDFRKGNLGRISLEEP

SEQ ID NO: 18920 - protein, 561 aa, Rhodospirillum rubrum ATCC 11170
MTTPQTILDDINARFPGCVTRGLAPQPDRLYLRTTTEHIRTLAAYVFNDLKGRLVTGVCTDMGPVTGEYDIIYAFSLDAEGILLTLTEPTDPKDPKVPTLTDLIPGADWHERENYDMLGVVAEGHPNPRRLLLSEDWPEDLFPMRKDFPHDFKPPKAEKITTPLRDPLGNESKATIISVGPFFPTLDEPAYFRLFCEGEEIIGSDYRGFFSHRGIEKLSDTVLDYNQVPFMAERVCGICGFVHSACYCMAVEDAAGIEIPPRAKYIRSIMMELERLHSHLLWLGLAGHYLGFDTVLMQSWRIREPIMWLVEEITGNRKTYGMNLVGGVRRDLDSAICDKIMAAVTKIGIECEELISAVAGDESLKMRMVKVGVLSHEDARGICVVGPTARASGVHIDARADYPYAAFPDLDFKPSFHEGGDIWARTLVRVDEVRSSVDLIKQMITKLPEGEIMAGFGPIPAWREGYGIAEAPRGECVHYVQTGKDNRPYRWRVRAATYPQLQAVPLMLKGMSIGDFPIIIGSIDPCFSCTERVLTVDTKSKAIRTYTEKDLLALTRRAGGR

SEQ ID NO: 18921 - protein, 242 aa, Candidatus Protochlamydia amoebophila UWE25
MGIQMNIYRLITLFIFTFALPGLSAEATNPQYTLAEDNQHKNQDDEDDEDWYDDDEDDDNQYQAHSPTPKEESQINTPKTSQVYPKITETTHPTLTQQKPTFASEQTLSIIKPDAVQNNYIGEIISRFEQAGLKIAAIKMTTLTKDQASKFYAIHKDRPFYNDLVNFMSSGPVVVMVLEGNQAIAKNRELMGATDPKKAEKGTLRADFAESMSRNAVHGSDSSETAEEEVLFFFKPDEITHR

SEQ ID NO: 18922 - protein, 357 aa, Arabidopsis thaliana
MMQSDLLKERGVDDSSPYSPDEKNVSGFQLDSHDLVSGECSTVYPRKSISLPSSPRSYQIQLSERSEHSPQEISHIWNEVLESPMFQNKPLLPFEEWNIDFSKLKVGASVGSGTSGVVCRGVWNKTEVAIKIFLGQQLTAENMKVFCNEISILSRLQHPNVILLLGACTKPPQLSLVTEYMSTGSLYDVIRTRKKELSWQRKLKILAEICRGLMYIHKMGIVHRDLTSANCLLNKSIVKICDFGLSRRMTGTAVKDTEAAGTPEWMAPELIRNEPVTEKSDIFSFGVIMWELSTLSKPWKGVPKEKVIHIVANEGARLKIPEGPLQKLIADCWSEPEQRPSCKEILHRLKTCEIPIC

SEQ ID NO: 18923 - protein, 143 aa, Candidatus Protochlamydia amoebophila UWE25
MTLERTLSIIKPDAVGNNHIGEIIARFEKAGLRIVAAKMKQLDRKDAEGFYAVHKGRPFFEDLVGFMTTGPVMIMVLEGENAINKNREIMGATDPKKAAPGTIRADFAQTIDENAVHGSDAAETAKTEIEYFFKSQDVCARKR

SEQ ID NO: 18924 - protein, 682 aa, Kluyveromyces lactis NRRL Y-1140
MSSVAASQNKINDLLEAIRQEFANVSQEANSYRLQNQKDYDFKINQQLAEMQQVRNTVYELELTHRKMKDAYEEEISRLKLELEQKDRQLASIAHGSTVGNVPGQVPQLSRNSGAQGNANIAPPNIPQPMVSQTVGTGMAPQMAPLNTQHPTQQTKSNAGEQAAANLAPVIQQQQQPQQQLPPQQQQQQQQQQQSNIPVTTAAPVQPAGGNLDQTVPNSISPQQQPTEQQQPASTATTAPATASTAPPTSAPSDQVGQDHYLVPADQRAVHAKPIPPFLLDLDSQLVPSHLKKQNNDYYVLHNPALPTDLDVELHKSLEHSSVVCCVRFSSDGEFLATGCNKTTQVYKVSTGELVARLSDDSASQPQPQPQNQTVTAETSTSNSNGSSAEDGTGNQNSAASTASSDLYIRSVCFSPDGKFLATGAEDKLIRIWDLETKKIVMTLKGHEQDIYSLDYFPSGNKLVSGSGDRTVRIWDLTTGTCSLTLSIEDGVTTVAVSPGEGKFIAAGSLDRTVRVWDSDTGFLVERLDSENELGTGHRDSVYSVVFTRDGKGVVSGSLDRSVKLWNLNGLSGQKSHAECEVTYTGHKDFVLSVATTQNDEYILSGSKDRGVLFWDTKSGNPLLMLQGHRNSVISVTVANGHPLGPEYGVFATGSGDCKARIWKYSKKNSQQNSTQIKEIKE

SEQ ID NO: 18925 - protein, 319 aa, Yersinia pseudotuberculosis IP 32953
MKDIRVPLRLVSILSDGFFHSGEQLGETLGMSRAAINKHMQTIRDWGLDVFTVPGKGYSLPTSIQLLDEQKILSYLPTGHVTVLPVVDSTNQYLLDRITELKSGDACVAEYQQAGRGRRGRQWVSPFGANLYLSMYWRLEQGPAAAMGLSLVVGIVMAEVLQNLGAEKVRVKWPNDLYLNDKKLAGILVELTGKTGDAAQLVIGAGINLTMRGSETNAINQDWINLQDAGVTIDRNKLTAEILSELRLAVVKFENDGLSAFLSRWQKMDNYLNRPVKLIIGNQEIFGIARGIDQQGALLLEQDGNIKPYIGGEISLRGV

SEQ ID NO: 18926 - protein, 78 aa, Arabidopsis thaliana
MGSSMLSSATMVASPAQATMVAPFNGLKSSGAFGASLKANNDITSITSNGGRVNCMQGIYISSFTFLIIHMIFFGSFF

SEQ ID NO: 18927 - protein, 560 aa, Arabidopsis thaliana
MGSSGDVNWKLADHPKLPKGKTIGLIVLDGWGESDPDQYNCIHKAPTPAMDSLKDGKPDTWRLIKAHGTAVGLPSEDDMGNSEVGHNALGAGRIYAQGAKLVDLALASGKIYEDEGFKYISQSFEKGTVHLIGLLSDGGVHSRLDQVQLLLKGFAERGAKRIRVHILTDGRDVLDGSSVGFVETLEADLAALRAKGVDAQVASGGGRMYVTMDRYENDWSVVKRGWDAQVLGEAPHKFKSALEAVKTLRAEPGANDQYLPSFVIVDDNGKAVGPIVDGDAVVTFNFRADRMVMHAKALEYKDFDKFDRVRVPDIRYAGMLQYDGELKLPSRYLVSPPLIDRTSGEYLAHNGVRTFACSETVKFGHVTFFWNGNRSGYFNEKLEEYVEIPSDSGISFNVQPKMKALEIAEKARDAILSGKFDQVRVNLPNGDMVGHTGDIEATVVACEAADRAVRTILDAIEQVGGIYVVTADHGNAEDMVKRDKSGKPALDKEGNLQILTSHTLKPVPIAIGGPGLSAGVRFRQDIETPGLANVAATVMNLHGFVAPSDYETSLIEVVEK

SEQ ID NO: 18928 - protein, 623 aa, Glycine max
MASSACTKPIFPSAFTVSKSKLSRHVHVSFTSPKPIYYHYRKLSHASQRSLVVNSVLKTVDPTQTSLRRSNSEDVGSLGEKPTILVSEKLGEAGLQVLRGVGHVECAYELSQEELCTKISCCDALIVRSGTKVTREVFEAGKGRLKVVGRAGVGIDNVDLQAATEFGCLVVNAPTANTIAAAEHGIALLAAMARNVAQADASTKAGKWQRSKYVGVSMVGKTLAVMGFGKVGSEVARRAKGLGMHVIAHDPYAPADRARAIGVDLVSFDHAIATADFISLHMPLTPTTNKIFNDNTFAKMKKGVRIVNVARGGVIDEDALVRALDTGIVAQAALDVFTEEPPSKDSKLVQHENVTVTPHLGASTKEAQEGVAIEIAEAVLGALKGELSATAVNAPMVAPEVLSELAPYVVLAEKLGRLAVQLVCGGSGIKSVKIVYRSARGPDDLDTRLLRAMVTKGLIEPISNTIVNLVNADFIAKQKGLRISEERVVVDSSPEMPVDSIQVQISSVDSKFASAVSESGQISIDGRVKFGEPHLTCVGSFDVDVSLEGNLILCRQVDQPGMIGRVGNILGEQNVNVSFMSVGRTSRRNKAIMAIGVDEEPNKEALDNIGAVPAIEEFVFLKL

SEQ ID NO: 18929 - protein, 198 aa, Lycopersicon esculentum
MASNSAFSLFLILLIITQCLSVLNAAKDFDFFYFVQQWPGSYCDTKQSCCYPTTGKPAADFGIHGLWPNNNDGTYPSNCDPNSPYDQSQISDLISSMQQNWPTLACPSGSGSTFWSHEWEKHGTCAESVLTNQHAYFKKALDLKNQIDLLSILQGADIHPDGESYDLVNIRNAIKSAIGYTPWIQCNVDQSGNSQLYQ

SEQ ID NO: 18930 - protein, 387 aa, Zea mays
MAMATAKLNSPATSLLAGGRTRRSAPARCTTVIRAAAGSYSDELISTAKSVASPGRGILAIDESNATCGKRLSSIGLDNTEVNRQAYRQLLLTTAGLGEYISGAILFEETLYQSTTDGKKFVDCLKDQNIMPGIKVDKGLVPLPGSNNESWCQGLDGLASRCAEYYKQGARFAKWRTVVSIPCGPSALAVKEAAWGLARYAAIAQDNGLVPIVEPEILLDGDHGIEGALEVAEKVWSEVFFYLAENNVLFEGILLKPSMVTPGAEHKEKASPEAIAKYTLTMLRRRVPPAVPGIMFLSGGQSEVEATLNLNAMNQSLNPWHVSFSYARALQNSVLKTWQGRPENVEAAQKALLVRAKANSLAQLGRYTGEGESDDAKKGMFQKGYTY

SEQ ID NO: 18931 - protein, 154 aa, Lactobacillus plantarum WCFS1
MANSEKTLVLVKPDGVSEGHIGEVITRLERKGYQIAALKVIKATAEQLQQHYSEKVGKPYFKEIETYMMEGPLVAIIVSGTGVVKAVHRLAGSTRPAEAQPGTIRGDFSHEYPDGILRNVIHTSDSRENAHHEIAIWFPELAVKARKADNKVKA

SEQ ID NO: 18932 - protein, 443 aa, Carboxydothermus hydrogenoformans Z-2901
MSPTKEDILKIVEEKGIRFIRLQFTDIYGIPKNVAITAEQLEKALDGELMFDGSSIDGFVRIEESDMYLKPDPSTFMILPWADQRYAEARLICDIYTYDGKPFSGCPRGNLKRILQEAKQMGIDEMYVGPEAEFFLFQTKEDGTLTTVTHDEAGYFDLAPVDRGENARRDMVLALEQMGFEVEASHHEVAPGQHEIDFKYDSAVRTADKVITFKTVVRKIAKKHGLHATFMPKPVYGIAGSGMHLNISLAAKGQNIFYDPSTPHQLSDIALYFIGGLLKHARAISAITNPLVNSYKRLVSGFEAPVYIAWSFRNRSPLIRIPAKRGPSTRIELRSPDPSANPYLAFAVCLKAGLDGIKNKIMPPPPCDRNIYHMDEEERKAWGIGNLPASLGEALKELEQDEVIREALGEHIFERYMEGKRLEWDTYRMQVHEWELKEYLVKY

SEQ ID NO: 18933 - protein, 233 aa, Lycopersicon esculentum
MMKSQKKLLIKIIVVQCLLVLCVTSQDFDFFYFVQQWPASYCDTRRSCCYPTTGKPDEDFSIHGLWPNYKDGKWPQNCDRESSLDESEFSDLISTMEKNWPSLACPSSDGLKFWSHEWLKHGTCSALNQHAYFQTALDFKTKSNLLQNLNNAGIKPRNGDYYGVESIKKAIEKGVGHTPFIECNVDSQGNHQLYQVYLCVDSSASKFIDCPIFPHGGKCGSKIEFPSFSTNDD

SEQ ID NO: 18934 - protein, 255 aa, Yersinia pestis biovar Medievalis str. 91001
MRHPLVMGNWKLNGSTHMVNELIAGLRKELSTVDGCGVAIAPPAIYLNQAKHELAGSRIALGAQNVDVNLSGAFTGETSAEMLKDIGAQYIIIGHSERRTYHQESDELIAKKFGVLKEIGLIPVLCIGESEAENEAGQTEAVCAKQLDAVLNTLGVKAFEGAVIAYEPIWAIGTGKSATPAQAQAVHKFIRDHIAKQDAAVAAQVIIQYGGSVNDKNAAELFTQPDIDGALVGGASLKADAFAVIVKAAAKAKKA

SEQ ID NO: 18935 - protein, 286 aa, Streptomyces coelicolor A3(2)
MSSPTPDALLGPADVRELAAALGVRPTKQRGQNFVIDANTVRRIVRTAEVRPDDVVVEVGPGLGSLTLALLEAADRVTAVEIDDVLAGALPATVAARMPARADRFALVHSDAMHVRELPGPAPTALVANLPYNVAVPVLLHMLDTFPGIERTLVMVQAEVADRLAAGPGSKVYGVPSVKANWYAEVKRAGSIGRNVFWPAPNVDSGLVSLVRRSEPLRTTASKAEVFAVVDAAFAQRRKTLRAALAGWAGSAAAAEAALVGAGVSPQARGEALTVEEFARIAEHKV

SEQ ID NO: 18936 - protein, 435 aa, Blastopirellula marina DSM 3645
MSDRRAFGLWTLTFLVIANMVGAGVFTTSGYTLASVGSPGWVVIAWLVGGLIALMGALSYGQLSRVMPESGGEYLFLSQALHPAAGFVGGWISLLAGFTGAIAYAAITLEKYVMHSVDLPFFNGAVAIVTVGICGLLHGLGTRLGAGLQNVVVLLKLALLGLFLFLAASSDIDWQGAPLAIDQQPEGWDFALAFGNSLIWIAFCYLGFNAAVYVASEAKNAGDVPRSLLLGTVIVVVLYVLLNSVFVYAPLPGAIANQAEVAAIAAEAIGGKSLSQLVSATIVIALFTSVMSMIMAAPRVYAKMADDGFLHHSFRAQESAPQTAIALQSVLAIGMILFYSHLKDLLDYLGLTLSLCAALTVACALLPAVRQGPLLRLASLPPVLYLLGTLVSALLMAINKPWALLPVAITFGLGGAVFLAIRGRAQPVIEQPFES

SEQ ID NO: 18937 - protein, 575 aa, Magnaporthe grisea 70-15
MADIQPARPSSGDKAKGAVGGDHVETTSGGPAEKALNEKEALEFARNGGDGEMNSLISSLERELEAEGGLRNGFFDLQFSNTKYFNWMIIAFASMGGMLSGLDQSLISGANLFLPTDLGLSTRELSLVNSAMPLGAVGGALILSPCNEFFGRRMSIMISCFLYTVGAAVCAGSINFGMIVAARVILGMGVGLEGGTVPVYVAETAERRIRGNVVSLYQLNIALGEVLGYAVAAMFLHVEGNWRWILGSSLVFSTIMWGGMLFLPESPRYLMHKRRTLDAFRVWKRIRGTDTPEAREEFFIMKVSVLDEQNAVTETARNKRFPWMDFFTVPRARRALVYANIMILLGQLTGVNAIMYYMSVLMKQIGFDDEKATYMSLVGGGSLLIGTIPACLYMEKFGRRFWANTMLPGFFVGLVIIGASYHIPIDTNTTGAAACYLVGLALYMGFFGCYACLTWVVPSEVYPTYLRSYGMTTSSGLLFLASFVVTYNFSAMQEAMTRTGLTLGFYGGIAVLGWFYQLIFMPETKDKTLEEIDQLFERPTREIVSENMRNLFGRRKSREDAAAAAVSEEKADVYA

SEQ ID NO: 18938 - protein, 582 aa, Glycine max
MLEKVEEFNTERMMEEFERVTKDAERIQRETLKRILEDNASAEYLLNLGLNGRTDPESFKAFVPLVTHKDLEPYINRIIDGDFSSVLTGKPITTMSLSSGTTQGKPKYVPWNDELFDTTLQIYHTSFAFRNREFPINNGKALGFIYSSKQFKTKGGVLAGTATTNVFRNPGFQHAMKAIQSPLCSPDEVIFGPDFHQSSYGHLLCGLIFREEVQLVSSIFAHSIVYAFRTFEQVWEELCVDIKEGVLNSKVTVPSIREAMSKLLKPDPELANLIHNKCMGLSNWYGLIPELFPNVKYVHGIMTGSMEPYLRKLRHYAGELPLLTSDYGSSEGWIGTNVKPTVPPELATYTVLPQIGYFEFIPLRELEEIKGDASFLCMEAKPVGLTEVKIGEEYEIVITNPAGLYRYRLGDVVKVMGFHNSAPEIKFVRRSNLLLSINIDKNTEKDLQLAVESASQLLAEEKLEVVDYTSHIDLSKEPGHYVIFWEISGEASEEVLGGCCNCLDKSFVDAGYTSSRKVNCIGALELRVVRRGTFQKILEHSLALGAAVSQFKTSRCVGPTNTKVLQILNENVVKNYLSTAFN

SEQ ID NO: 18939 - protein, 270 aa, Zea mays
AANTLVSLAQLGGTGFYACKVGKDEAGAFYLQDLNDCGLDTNPHHETAGEGITGKCLVFVTPDADRTMNAFLGISGSLSVTEMDWSALKQSQYLYLEGYLVTSPSAKAACIEAKAIAEQSGVKTCLSLSDPNMAKFFQDGLKEMLGSGVDLLFANEAEALEMAGTSDLNQAIAYCKSIAKNFALTRGGAGSLIFDGENLLTIGTPKVQPIDTVGAGDMYAGGFLYGLTHGMDYEKAGQLASETAAKVVTCYGPRLDTEILQEILQSVQAV

SEQ ID NO: 18940 - protein, 405 aa, Escherichia coli O157:H7 EDL933
MSPIEKSSKLENVCYDIRGPVLKEAKRLEEEGNKVLKLNIGNPAPFGFDAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVEIARQHNLIIFADEIYDKILYDDAEHHSIAPLAPDLLTITFNGLSKTYRVAGFRQGWMVLNGPKKHAKGYIEGLEMLASMRLCANVPAQHAIQTALGGYQSISEFITPGGRLYEQRNRAWELINDIPGVSCVKPCGALYMFPKIDAKRFNIHDDQKMVLDFLLQEKVLLVQGTAFNWPWPDHFRIVTLPRVDDIELSLSKFARFLSGYHQL

SEQ ID NO: 18941 - protein, 338 aa, Triticum aestivum
  misc_feature (132)..(132): Xaa can be any naturally occurring amino acid
  misc_feature (164)..(164): Xaa can be any naturally occurring amino acid
  unsure (1)..(338): unsure at all Xaa locations
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPXVVCGVNEKEYKSDIDIVSNASWHTNWLAPPCXVINDRFGHWLRGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSSK

SEQ ID NO: 18942 - protein, 220 aa, Brassica juncea
LADVKLDCSYQLLVTNLWGLYRMRIGDIVKVTGFHNKAPKFRVIGRENTLLSIDTDRTTEEYLLKAVNRARLVLESSDLRLVAFTSCADIPSSPGHYVIYWEVKTKEEDMKELDEKTFLECCSVMEDTLDEEYMYCRANEFIGPLEIRVVNDGTFDSLMNLSISKGASITQYEYWRQMWLLDSSVLSEHLMCLSHDIWSKKRGRNVCVLSVLSCFLLTIF

SEQ ID NO: 18943 - protein, 559 aa, Candidatus Protochlamydia amoebophila UWE25
MVNSMDSHNLKIVLILAFGFSLAGILGYITHRLKLSPILGYLLAGYIIGPYSPGFVADVNVSEQLAEIGVVLMLFGVGLHLKWEDLVNVKNIAIPGAIGQTLVAAACGAWIVYAIGWPIEVGIIVGLAIGVASTVVLVRVLSDNHLLDTLEGHVSIGWLIVEDILTVIVLILLPVISTFAKEGNLPLIELLETLGWTVFKFLLLALVMFTFGKKIVTFILMHIARLRSHELFTLALLALTFMIAVASALVFGTSIALGAFIAGMVIGQTHVKHQAAANALPMKDAFAVIFFLTVGMIFNPMAIMENFTLFIGILAIVVVIKPLAAFLIVVVMRYPVKVALTVALALAQIGEFSFILGEEAIKFHLLPDEGYDIIVACALISISINPLLFKGINFLQNSIESVQNTYNPLVPNDIPPVFHSLHAIVIGFGPLGRAIAQTLEQQNFDVTVIDQNVDTIAFLSDSHQRAVFGDATLPTILEDAHIKDADLLLITVPNLNITLKIIQVAQPLNSEMKILARANYLTDQQKLQNLNIQSVCSEEETKQAFIKMVDRIVKEELEA

SEQ ID NO: 18944 - protein, 265 aa, Desulfovibrio vulgaris subsp. vulgaris str. Hildenborough
MQTTLGCIGCGNMGSAILRGLSGREGLRLVGCDPTGAKLAALADAGVEGVADIAAAVRASDIVLVAVKPGQVGAVLGAAMPELDSGKVVVSIASGVSVGSLREMSGGRCPVVRVMPNTPAMVGAGVFALCFEDATLDEVRRTLVKELFEALGRVLVLPEEKFNAFTAVVGCGPAYVFHFMEAVVEAAVTLGFPRHEATDMVVDLFAGSVKLAATSGTHLSLLREAVCSPAGNTIAAMNQFDRDAVRGRIIDAILAAYRRGQEMER

SEQ ID NO: 18945 - protein, 139 aa, Desulfovibrio vulgaris subsp. vulgaris str. Hildenborough
MVERTFSIIKPDAVERNLQGEVLAMIQGAGLKVVAMKMIHLTKAQAEGFYAVHRERPFFDSLTTYMCSGPVVCSVLEGENAISRYREIMGATNPANAAEGTIRKKYAVSLEANSVHGSDAPETAAFEISYFFNALEIVG

SEQ ID NO: 18946 - protein, 510 aa, Listeria innocua
MSKSPVAIIILDGFGKRAETVGNAVAQANKPNFDRYWANFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLEKAISDLNYGAIATVSGRFYAMDRDKRWERVEKAYKAIVSAEGEKFEDPIELVKASYANDKNDEFVVPAIITKDGKPVATVKDNDAVIFFNFRPDRAIQLSNAFTDKEWDHFDRGANHPKNIKFVTMTLYNPSIDAEVAFEPIEMKNVIGEVLSNEGLSQLRIAETEKYPHVTFFMNGGRNEEFPGENRILINSPKVETYDLKPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 18947 - protein, 519 aa, Candida apicola
MNINFSDALMLGGISLSFLLASQAIYFYFIYSPRAKKLGCAPPPIFFSFPLGIPDLIRLVNAWFHDDLLEWFTHRFEEFGRRTAFQSVAGQLWIGTIEPENIKTMLATSFKDYSLGFRYNAMYGLLGNGIFTLSGDGWKNSRALLRPQFSREQVSHLESMRTHINMMINNHFKGGQVVDAQVLYHNLTIDTATEFLFGESTNTLDPALAQQGLPGPKGLVTGEQFAEAFTSALELLSVRVMAGAAWFLVWTPKFWRSCKVCHNFIDYFVYKALATPMEKGQDADRYVFIRELTKETSDPRVIRDQALNILLAGRDTTAALLSFTTYYLGAYPEVYDELREAVIADFGSADAEPPTFEQLKQCKVLQNVIREVLRLHPNVPLNFREAIADTTFPTGGGPNGDQPIFVPKGQKVFYATYVMQRNAGIWGPDSTSFRPDRWNEPREALASGWDYIPFNGGPRICLGQQFALTEASYTLVRICQEFSRIEVLHPDVITARNVMKQRMRLPNSSSGGVITRFIR

SEQ ID NO: 18948 - protein, 251 aa, Listeria innocua
MRKPIIAGNWKMNKTAAKAGQFAEDVKNNVPSSDAVESVVAAPALFLQELVRLTEGTNLRVAAQNCYFEDEGAFTGEISPFALADLGVSYVIIGHSERREYFHETDEDINKKAHAIFKHGMTPIICCGETLDQREAGQTDTWVRGQIRAALAGLTEEQVIKSVIAYEPIWAIGTGKSSTSADANETCAVIRAEVADAVSQKAADAVRIQYGGSVKPENIADYLAESDIDGALVGGASLEPASFLALLEAVK

SEQ ID NO: 18949 - protein, 468 aa, Sulfitobacter sp. EE-36
MSTKDFLKKIKDEDIEYVDVRFTDTRGKLQHVTIVSDLVDEDFVEEGFMFDGSSIAGWKSIEASDMKLMLDTDTAYVDPFYAEKTICVHCSVVEPDTGEAYERDPRGTAQKAEAYLKASGIGDVAYMGPEAEFFLFDNVKFSNSINKVSYEVDASDASWNTDTDYEMGNMGHRPGLKGGYFPVNPTDEAQDLRAEMLSTMKRLGMKVDKHHHEVASCQHELGLIFGTLTEQADELQKYKYVIHNVAHAYGKSATFMPKPIYGDNGSGMHVNMSIWKDGKPLFAGDKYADLSQEALYFIGGILSHAKSLNAFTNPATNSYKRLIPGFEAPVLRAYSARNRSGCVRIPWTESPKAKRVEARFPDPAANPYLCFAALLMAGLDGIKNKIDPGEAMDKNLYDLPAEELADIPTVSGSLREALEELQSDMDYLLAGDVFTKDQIEGYIELKMEEVHKYEHTPHPVEFGMYYSC

SEQ ID NO: 18950 - protein, 295 aa, Nostoc sp. PCC 7119
DVPVNLYRPNAPFIGKVISNEPLVKEGGIGIVQHIKFDLTGGNLKYIEGQSIGIIPPGVDKNGKPEKLRDYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 18951 - protein, 468 aa, Yersinia pestis
MLLPVIMAGGAGSRLWPLSRALYPKQFLALTSDLTMLQETLLRLDGLPHLAPLVICNEEHRFIIAEQLRQKNLVHSGIVLEPVGRNTAPAIALAALRATMSGDDPLLLVLAADHVIQDKLAFIRAVQRAEPLAEAGKLVTFGIVPKSPETGYGYIRQGKQVVDGAYQVAAFVEKPDLITAERYLASGDYYWNSGMFVFKASRYLQELDLHRPDILAACKQAIAGQHTDLDFIRLNEEAFSSCPDESIDYAVMEKTSDAVVVPLDAQWNDVGCWSALWEINTKDDHGNVIRGDVLIEDTNNSYVYSQNRLIATVGINDLVIVETKDAILVAHKDKVQNVKGIVGQLKLESRCEYLQHREVYRPWGSHDAIAEGVRYHVQHVTVKPGQRIATQIHYHRAEHWIVVSGIAKVHYGKETYLVNENESTYIPVGIAHSIENPGQIPLEIIEVHTGNYISEDDVERIDDLGVGY

SEQ ID NO: 18952 - protein, 295 aa, Nostoc sp. PCC 7119
DVPVNLYRPNAPFIGKVISNEPLVKEGGIGIVQHIKFDLTGGNLKYIEGQSIGIIPPGVDKNGKPEKDRDYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 18953 - protein, 699 aa, Oryza sativa (japonica cultivar-group)
MDDTPTSSGKSEVNSCEPSWWPPDFLAKIESVSLSRKQSVFSDKEPRSNLRSSSWKASQLLWSTGTYSGFIPNGFYSIIPDKKLKENFPTIPSLDDLQTLEADGLKADIIIVDVERDKKLFMLKQLSGALVKGLNSSPALVIKKIAGLVFDCFKSLDPDVSPARSPTEDNHFFGNKGSQLLGQIKHGSCRPRAILFKVLADAVGLESKLVVGLPDDGGVGFVDSYKHMSVVVSLNSMELLVDLMRFPGQLIPFSAKAIFISHISAAGESDSAENDSCDSPLEPNSPLYGLSDKVEAEGAFSKKVLVAWFFETAHHAASQILQMPFGGEAREEELLKNLAVLVQVSFTLFVNLLIHLTSQEHTCRSDGLGGASTSKTRRIRGRSISITPEIGDDIVRAVRAMNETLKQNRLQRDHVNEGSPSYVGEDQNNASDCPNNDDTSGGVVATNNGPRNRNGSTQKAMSLPSSPHEYRAQISETINPCDFVRFFGEVFRGIWNGTDVAIKVFLEQDLTTENMEDFCNEIYILSLLFNHNMHTNFENFTISFQPAAASKWGLMCIHRMKIVHRDLKSANCLVNKHWTVKICDFGLSRVMTDSPMTDNSSAGTPEWMAPELIRNEPFTEKCDIFSLGVIMWELCTLSRPWDGISPVQVVYTVANEGSRLEIPEGPLGKLIADCWAEPQDRPSCQEILTRLLDCEYAVS

SEQ ID NO: 18954 - protein, 244 aa, Zea mays
  misc_feature (21)..(21): Xaa can be any naturally occurring amino acid
  unsure (1)..(244): unsure at all Xaa locations
MYKLGRGNRDKVQQFMTITGXQALKASDWHLEGAFDFFYSQPQVSVVNTRHLEDIFNRYKEPDADMIMVEGISQFCNDLQVDPQDIVMLVISWHMKAATMCEFTRQEFIGGLQSIGVDSIEKFRGKLPSLRAELKDDNKFRDIYNFAFTWAREKGQKSLSLETAIGMWQLLFAERNWPLLDHWCQFLQVRHNKAISRDTWSQLLEFVKTTDPQLSNYDDEGAWPYLIDEFVEYLTENGLVQRKR

SEQ ID NO: 18955 - protein, 119 aa, Zea mays
  misc_feature (50)..(50): Xaa can be any naturally occurring amino acid
  unsure (1)..(119): unsure at all Xaa locations
MGTASTSSDTMEAARLPGLSITVEKNPPEARLLQLGVKSWPKDPYIICEXWGCPPGRFPLKFDAALTCYLVKGRVRAAVKGSRECVEFGAGDLVVFPKGLSCTWDVVVGVDKHYNFDPS

SEQ ID NO: 18956 - protein, 339 aa, Synechococcus elongatus PCC 7942
MAQSTTSETHTRDLDRDCTTLSRHVLEQFQSFSPEAQDLAALMQRIGLAAKLIARRLSHAGLVDDALGFTGEINVQGEASKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFCSGPKVSPVHPGNASPRRLQRRYSGALVADFHRILMQGGVFLYPETVKNPTGKLRLLYEAPPMAFLAEQAGGKASDGQKPILLRQPQALHRRCPLIIGSAADVDFVDSLLG

SEQ ID NO: 18957 - protein, 223 aa, Debaryomyces udenii
GRTTGIVLDSGDGVTHVVPIYAGFSLPHGILRIDLAGRDLTDYLMKILSERGYTFSTTAEREIVRDIKEKLCYVALDFEQEMQTSSQSSAIEKSYELPDGQVITIGNERFRASEALFRPSDLGLEAAGIDQTTYNSIMKCDVDVRKELYGNIVMSGGTTMFPGIAERMQKEITALAPSSMKVKIIAPPERKYSVWIGGSILASLSTFQQMWISKQEYDESGPS

SEQ ID NO: 18958 - protein, 135 aa, Cryptococcus neoformans var. neoformans JEC21
MDALIPFTTSGSLVDLVDKKVLVILRDGRKLIGLFRSYDQFANFLLESCVERLHYKLEYADKDIGVLLVRGENVVALGEIDLIAEDMVPLQQVNVQEIEEKISAENKQRERDHAVKESVLSKMGFVNEGKEGDAY

SEQ ID NO: 18959 - protein, 1065 aa, Oryza sativa (japonica cultivar-group)
MASSRAAKRPKVDPSSSSSAPPPPPPPPQRGDDDYVPGNIVEIELCNFMTYDHLTCRPGPRLNLVVGPNGSGKSSLVCAIALALAADPAILGRASSVAAFVKRGEDSGHVKISLRGNTPDHKLCITRKVDTNNKSEWQLDGTTVPKKEVIDLIKKFNIQVNNLTQFLPQDRVCEFAKLTPIQLLEETEKAVGDPNLPIQHRQLIDRSKELKILQVAVKQKEQTLNNLKALNAELEKDVERVRQRDRLLKKAELMKKKLPWLKYDMKKKEYKEAQEKEKTEKKKMEEVAKIWEDSKGPVEELKKKKMSHTSNTKRINSHMAENMKRRQDITHKELQLKGQLRATLEDIEDLKRQERSRQQRILKAKEALAAAERELDDLQPYEAPKAEMIQLTEEIARLTCDINELKRKKTDMESQLVRERENLRNCSDRLKQMENKNNKLLQALRYSGAEKINEAYNWVQDNRHMFRAEVYGPVLLEVNVQDKVHASYLEGHVASYIWKSFITQDASDRDLLVRQMKQYDIPVLNFMGDKGIRREPFNITLEMQQVGIYSRLDQVFEAPPAVKDVLISQANLDRSYIGTDETHNRADDVPKLGISDFWTPDNHYRWSRSRYGGHLSAFVDAVNPSRLFMCNLDVIDSERLRSQKDKHIKDIDGMDEDLKKLLKEQRQLEDEAAKIRRKKEEITDTMMFEKKRQEETRRRVDIKRRMLETIYKEEDMESSKRKFVDQAAKLNDQRYELVLKLKDLLIEAVALKWSCTQKNMASIELDTKIWEMEKDVKKLEKNAIEAAKEYENCKRKTQEHKQQLSNAKQHAESIAMITEDLAKKFLEMPTTIEELDCAIQDTESEANSMLFLNQNVLLEYQSRQREIESISIKLEDDKGECERCYSDIEATKGKWLPTLRTLVSKINSTFSRNFQEMAVAGEVSLDEHGLDFEQYGILIKVKFRQTGQLQVLSAHHQSGGERSVSTILYLVSLQDLTNCPFRVVDEINQGMDPINERKMFQQLVRAASQPNTPQCFLLTPKLLPDLEYSDACSILNIMNGPWIEKPAKAWSTGDCWRTVMSVSGH

SEQ ID NO: 18960 - protein, 170 aa, Glycine max
  misc_feature (15)..(15): Xaa can be any naturally occurring amino acid
  misc_feature (21)..(21): Xaa can be any naturally occurring amino acid
  unsure (1)..(170): unsure at all Xaa locations
YMLLCKIMLNTQKDXQALVSXKLALGYAGRQTEALKCVAQASKNRSLADFEKALTDYRAELRDDPIISTHLAKLYDNLLEQNLIRVIEPFSRVQIEHISSLIKLSKADVERKLSQMILDKKFHGILDQGEGVLIIFDEPPVDKTYEAALETIQNMSKVVDSLYSKAKKLT

SEQ ID NO: 18961 - protein, 211 aa, Sinorhizobium meliloti
MSGTLVLVRHGQSDWNLKNLFTGWRDPDLTELGIEEAKAGGKALADYGIKFDIAFTSVLIRAQRTCQLVLDAVGQSSLETIRDQALNERDYGDLSGLNKDDARAKWGEEQVHIWRRSYDVPPPGGESLRDTGARVWPYYLTDILPRVLSGEKVLVAAHGNSLRSLVMVLDKLTKEQILKLNLATGVPMVYKLNADSTVASKEVLGDMSGAH

SEQ ID NO: 18962 - protein, 135 aa, Gloeobacter violaceus PCC 7421
MRNAMETSQMLSPDIDIVASTVLRPWGSFTVLGEGNGYKVKRIEVKPGHRLSLQMHHHRSEHWVVVSGTARVVCNDRIELIHANQSTYVPPCATHRLENPGIIPLVIIEVQNGQYLGEDDIIRFEDDYKRIEPRS

SEQ ID NO: 18963 - protein, 526 aa, Gloeobacter violaceus PCC 7421
MPKVLVSDAIDQAGIEILTQVAQVTYEPDLSPATLLETIPQYDALMIRSGTKVTALVIEAAQRLRIIGRAGVGVDNVDLQAATRKGIVVVNSPEGNTIAAAEHAIALMMSLSRHVGEANASLKAGQWKRSQFIGVEVYKKTIGVVGLGRIGSHVTRVARALGMQIVAFDPYISAERAQQLGARLVDLEQLFHEADYITLHVPRTPETTHLINEKTLASMKPTARIINCARGGLIDEQALYVALKEGRIAGAALDVFENEPLGESPLCALGREVILTPHLGASTEEAQTNVAIDVAEQIRDVLLGLPARTAVNIPGLRAEVLQELKPYLELADTLGNLVGQLAGGRVDALDIRLQGILAAKDAQPIVVAALKGLLTPALRERVNFVNALLEAKERGIRVTETRDSAFADYAGSIRLEARGPEGERSVTGALLAEDELRITNIDEFPISVAPSRYMLITLHRDMPGIIGKVGSFLGSYNVNIAGMQVGRKLVRGDAVMMVSLDDPLPEGLLGEIESVPGIRKAYTVNL

SEQ ID NO: 18964 - protein, 405 aa, Zea mays
MEVAAVACRAGLLARARPSSRARTWAVAVGPAPSAARRRLLVASLGVGEPLPAQSLGEEAVALEVGEEEDDLNSIVSVENLPPAAAHGMSSLAVSGVVYTDDKKKKKKNPTTLTLARLVNLTVPVPEARRTTVRVRFVLRKQCAFGHQFLVAGDDAALGLWDPAKAISLVWSEGHVWTANTDLPANRSIEFKFLLRDASGHAHWQHGANRTLRITTETPNTVVVHEDWDHGNKQKVSEEEELSIGEDVMFPDDLAGTDGASAMPADNPEKHQNVETDSDRSAAVVADAPPQQEMVAANGTGQPQLVVDGHKTILEEVPGEENGTLSAANYAGNGSIDDDDDDDTTLYQGGDVLPNRPTSIFENDLAWAGKAMQQLLRVLGFQIGTTRTTPVNPIEANVLQEGIRK

SEQ ID NO: 18965 - protein, 314 aa, Vibrio cholerae O1 biovar eltor str. N16961
MVNNSIQWFPGHMHKARKEIEEAIPQVDVIIEVLDARIPFSSENPLISHIRGEKPCVKVLNKRDLADPELTELWIAHLEQEKGVKAMAITTSNPQEVHKILELCRKLAPQREEIGKNIRTMIMGIPNVGKSTIINTLAGRAIAQTGNQPAVTRRQQRINLQNGIVLSDTPGILWPKVENPHSGFRLAATGAVKDTAMEYDEVAFYTVEYLAKHYPERLKERYQIDELPETDVELMEEIGRKRGALRAGARVDLHKASEILLHELRQGVLGQITLERPEMITEELQQVEIDEALKAEEKAKRKEERRKRYLRNKR

SEQ ID NO: 18966 - protein, 209 aa, Stevia rebaudiana
MASASLFKPSPATVLDKSDWVKGQTLRQVPVSVVRFNAAAPSALTVRASSYADELVKTAKTIASPGRGILAMDESNATCGKRLASIGLENTEANRQAYRTLLVSAPGLGNYISGAILFEETLYQSTIDGKKIVDVLAEQGIVPGIKTDKGLVPLAGSNDESWCQGLDGLASRSAAYYQQGARFAKWRTVVSIPNGPSALATKEAWESLK

SEQ ID NO: 18967 - protein, 330 aa, Sinorhizobium meliloti
MAKYDVLTIGNAIVDIIARCDDSFLEENGIIKGAMNLINADRAELLYSRMGPAVEASGGSAGNTAAGVASLGGRAAYFGKVADDQLGEIFTHDIRAQGVHFQTKPLDGHPPTARSMIFVTEDGERSMNTYLGACVELGPEDVEDDVVAQSKVTYFEGYLWDPPRAKDAIREAARIAHAHGRETAMTLSDSFCVHRYRSEFLELMRSGTVDIVFANRQEALALYETEDFDRALELLARDCKLAAVTLSEEGSVVVRGAERVRVGASVLEQVVDTTGAGDLYAAGFLFGYTSGRSLEECSKLGNLAAGIVIGQIGPRPLVSLATAARQAALV

SEQ ID NO: 18968 - protein, 137 aa, Arabidopsis thaliana
  misc_feature (26)..(26): Xaa can be any naturally occurring amino acid
  misc_feature (28)..(28): Xaa can be any naturally occurring amino acid
  misc_feature (36)..(37): Xaa can be any naturally occurring amino acid
  misc_feature (47)..(47): Xaa can be any naturally occurring amino acid
  misc_feature (66)..(66): Xaa can be any naturally occurring amino acid
  misc_feature (101)..(101): Xaa can be any naturally occurring amino acid
  misc_feature (117)..(117): Xaa can be any naturally occurring amino acid
  unsure (1)..(137): unsure at all Xaa locations
FIPFIPLCPGYIPPPPSPLAGASYTXKXLRNRIPPXXPGIMFLSGGXQSDLEATLNLNAMNQAPNXPWHVSFSYARALQNTCLKTWGGKEENVKAAQDILXLARAKANSLAQLGKYXLGEGESEEAKEGMFVKGYTY

SEQ ID NO: 18969 - protein, 284 aa, Leuconostoc mesenteroides subsp. mesenteroides ATCC 8293
MAQIIQWFPGHMAKAFRLMRENLKLVDVVFELVDSRIPESSRNPEVDKLIGNKPRLLIMTKADLADPDQTRAWKKHFEAQGYTVLVLDTRDPRTPQLVTKAARRAVEAKKAAQLAKGIQDQPIRAMISGVPNVGKSTLLNHLVMKNVAPTADRPGVTKKIAWLKTPTKLELLDSPGVLWPKFEDQNIGMKLALTGAVKDTIFAKDDAALFLINFFREYRPEAIIERYHLNDNIFDQENVDVLLSITSKLGFKDDYDKASERILNDLRKNKLGAFTLDLIETKND

SEQ ID NO: 18970 - protein, 386 aa, Bacteroides thetaiotaomicron VPI-5482
MIQLSEITNSISPSLTRRLFNLAQKYDNVIDFTLGDPDIHPHDKIKEAGCKAILEGRTRYSPNAGLLELREIISSRYKLQYNIEYNPTNEIMVTVGGMEGLYLTLLAILNRGDEVIIPAPYWINYVQMVCMCSGEPIITAPVSTNDLSISIENIRKAITPKTKAIILNTPSNPSGRIISDDSIQQIAQIAIENDLIVITDEVYKTLLYDNAHFKSIVTCDKMKERTVVINSLSKEFCMTGWRLGYIAAPSELISVMTMFQENIAACAPLPSQYAAIEALRNSEKYSAGMIEEFTLRRNVLLEEVAKIKTITVDAPQGTFYAMLNIKSTGLKSEEFAYALLEKEQVAVVPGITYGDCCEDFIRIAFTLDIYKIKEGIQRLKRFVESL

SEQ ID NO: 18971 - protein, 265 aa, Sulfitobacter sp. EE-36
MAEMKITILGCGSSGGVPRLGGHWGACDPANPKNARRRCSILVERITDAGTTSVLIDTSPDMRSQLLDAGVGRLDAVLYTHSHADHVHGLDDLRMIVINMRQRLPVWADTPTREALLDRFGYVFIQPPGSSYPPILEMNHIDGDVTIDGPGGTLCFTPFLVNHGGMDALGFRVNDVAYLPDVAQIPDDIWPHLKGLRCWIVDALRRDPHPTHSHLAQTLDWIEQMAPQTAVLTNMHNDLDYDTLAAETPDHIEPAFDGMTLSFPV

SEQ ID NO: 18972 - protein, 554 aa, Aspergillus nidulans FGSC A4
MEPFLRGNLRWCLWIWALCYATAVAFNPLSKLRGTQSHLNSVEAGPKQVAVIGAGAAGASTAYSLRKYADSFGIPVNITVFERASYIGGRSTTVNVFDDPAYPIELGASIFVQVNYNLVNATKELGLDVRGASTERPGDTAAIGVWDGKEFVFVMEDSSSWWNIAKLLWRYGLSPVRAQNLMKGTVNKFLQLYQEPLFPFKSLTAAAASVGLLDATSTTGATFLEKNNVSPGFSRDLIQASTRVNYGQNLPLIHGLETMVCLATDGAVAVEGGNWRIFEGMLKSARANVQLNHTVTSITQNKDKSVTLDFKDEQSIKQQRADFDEVVIAAPYQYSGINISPAPKHTPDTIPFHTLHVTLFSSPHRLSGKYFNLKNPSDIPPETILTTLPLGSDLGNAEEGVGPAAFWSISTLRTVKAPSTSNPPEDRESETKHYVYKIFSPTRPNEAFIREILGLEQKKIKKAGYITDLPKEDISWSYEKLWHPYPFLYPRVTFEDPLLAPGIWYTGGIESFISTMETSALMGKNVAALMSQGWLDKGFVDSPVVEDELGRTEL

SEQ ID NO: 18973 - protein, 628 aa, Glycine max
VIVLLARIIDGVAIALAVTLTPLYISEVAPADIRGQLNTLTQFACSGGMFFAYILVFSMSLSDSPSWRLMLGVIFIPAIAYFLLAVFYLPESPRWLVSKGRLLEAEIVLKRLRGTEDVSGELALLVEGLSPGGEATSIEEYVVAPASELLVNQEAGKDYIKLYGPNDEGVTMVAQPVNGQGSMISRSMLSQQGSFGTLTGGGLKDPIVTLFGSLHENTLPESGGSRSMLLHNANSIFSIGETSSPFGTSDNLHAPLMSFQGGAGEKDRAYGSKDILGMRSNSSLRSNSSLVHGNAVDAPKNTNIGGGWQLVYKSADGAGGGKREGLQRVYLHADTAALSHSQHVSFVSTSGYDIPIDGGEAYQAAALVSQSVLGTHDMLHLTEVAAKGPKWRALLEPGVKRALIVGVGLQILQQAAGINGFLYYAPQILEKAGVGDLLSNLGLSSASASFLVNIITTFCMLPCIAIAIRLMDISGRRSIMLYTVPILIVCLLILVIKQFFQINSVVDAAITAISVVVYESVFCMGFGVIPNIICAEIFPTSVRGICISLTSLTYWGCTLIVTLIFPYLLQLLGLTGVFGLFVVGCIISWIFVYLKVPETKGMPLEVIIEFFAIGAKPGTDPAALGIKG

SEQ ID NO: 18974 - protein, 370 aa, Arabidopsis thaliana
MSITNTKTSICFSSSSSLPESVRLAQVTMQGGSSGIGYGLKYQSRCISDVKADTDYTSFLTGTLSLKEENEVHLLRLSSGGSELICEGLFSHPNEIWDLASCPFDQRIFSTVFSTGESFGAAIWQIPELYGQLNSPQLERVASLDAHVGKINCVLWWPSGRCDKLISIDEQNIFLWSLDCSKKSAEVLSKDSAGMLHSLSGGAWDPHDVNAVAATGESSVQFWDLRTMKYGITVAILCCCMQLGEDESGIHVWDLRKAKVPVQELPGHTHWTWAVRCNPEYDGLILSAGTDSVVNLWYASATSSDDKTSESPVESTRQRVNPLLNSYTDYEDSVYGLAWSSREPWVFASLSYDGRVSKLSLPHILSTRST

SEQ ID NO: 18975 - protein, 363 aa, Bacillus anthracis str. A2012
MGILMKKDGGNMTIDRVCTIGPASNNKETLAKLINNGMKIVRLNLSHGTHESHKDIIRLVKSLDDSIKILGDVQGPKIRLGEIKGEQITLQAGDSFMLRTQPVTGSSTEASVDYEGIANDVKVGSRILMNDGEVELIVEKVSTDKIETKVKTGGNISSHKGVNLPGAIVSLPAITEKDKKDIQFLLEEDVDFIACSFVRKPSHIKEIRDFIQQYKETSPNLIAKIETMEAIENFQDICKEADGIMIARGDLGVELPYQFIPLLQKMMIQECNRTNTYVITATQMLQSMVDHSIPTRAEVTDVFQAVLDGTNAVMLSAESASGEHPVESVSTLRLVSEFAEHVKKDGPFVMKDVLELLHKSLDE

SEQ ID NO: 18976 - protein, 837 aa, delta proteobacterium MLMS-1
MSKAKTPPSPPPPATGQQVTAPYCNFGGSLDDEKLASTINHHLLSFLGRDPMRAGNRELYKAVAYTVRDLLIERWIRTQKESYARNRKRVYYLSLEFLIGRSLDNSLVNLGLYDKFAMVLKKMGYSLEEISEQEEDAGLGNGGLGRLAACFLDSMATQGIPAYGYGIRYEYGLFYQRLLDGFQVEHPDNWLRYGTPWEYNRPWNLYSVKFHGRVHHYRDAAGKLRCEWVDTDEVMAMANDILVPGFNNESVINMRLWSAQASRDLDLVSFNRGDYVQAVQDVVESETLSKVLYPSDDIREGQELRFKQQYFFVAATFQDILRRYKKQNGKDFGKFNDEIAVQLNDTHPAVAIPELMRLLLDDEGLDWEQAWDICVATFGYTNHTLMPEALETWAVDLFERLLPRHLEIIYEINRRFLGEVAARYPGDQERQQRMSLIDEGEVRKVRMAHLAVVGSHSINGVAELHSKLQKEWIFKDFNDLYPHRFNNKTNGITQRRWLLKSNPGLAQLITEHIGGQWVTDLDVLRQLEPLVDHEKFQHRWRAVKYDNKLRLTRLIKESCALKIDPDSLFDVQIKRIHEYKRQLLNVMHVIVHYQRLVQGRRSEAPPRTVIFAGKAAPSYARAKLIIKLINEVAMVVNHDRRVNDRLKVVFLPNYGVSLAEKIIPAADLSEQISTAGTEASGTGNMKLALNGALTCGTMDGANIEMSQEIGQENMFIFGLDAEEVARARRDPEWVPVKVYRNNPEVREAVDAVASGYFSRGDSALFKPLVESLLDPADPYLTLLDLEDYLRCQEEVDRQFADQALWTRKSILNVARMGKFSSDRTIRQYAEEIWGITP

SEQ ID NO: 18977 - protein, 536 aa, Phanerochaete chrysosporium
MGLTQAQRLVLGQLARLVAPALAVCVLLAAARRTQLVRAPVWADALIALIAIPLFHVGRAHWRVDVLQLVDEAYRRGFLSDYFYEKFGELGHTYNFYVLWDMDYCTEDAAVIKAVLATDFNNWVKGERFDSYMHSVLGTGVFNADGELWKFHRSMTRPFFARERITDFETFNRHAEEAILKMKERLREGFAVDFADLISRFTLDAATEFLFGACTTSPRRSARRRTQSRIARASRTDTPMRTVDRYLTPIIERALAMSRAAKQAPQGEKEEVADGETLLDHLARYTTDPTILHDEILNIMIAGRDTTGGTLTFVIYFLTQHPDVLQRLRQEILDVVGPSNLPTYDDIKQMKYLRAVLNETQRLYPPVPWNMRYAVEDSIVPNSEPEGKPWFIPAGASVSYSVHCMHRRKDYWGPDAEEFDPDRFLDERLHKYLTPNPFIFLPFNAGPRICLGQQFAYNEMSFFLVKLLQTFEDISFERDAFEPNALPPAEWAKFPGRKGKEKFWPRAHLTLYSEVRMTAGGMWVKMREAQAMGQVA

SEQ ID NO: 18978 - protein, 371 aa, Eriobotrya japonica
MGKGGMSDGDHADRCCGEAINGDVQQENMAAWLLGVKNLKIQPYKLPNLGPHDVRVRLKAVGICGSDVHHFKNMRCVDFIVKEPMVIGHECAGIIEEVGSEVEDLVPGDRVALEPGISCKRCNLCKQGRYNLCRKMKFFGSPPNNGCLANQVVHPGDLCFKLPDNVSLEEGAMCEPLSVGIHACRRANVCQETNVLVVGAGPIGLVTLLAARAFGAPRIVIADVNDERLSIAKSLGADEVVKVSTNIEDLAEEVATIQKVLENGVDVSFDCAGFDKTITTALSATRPGGKVCLVGMGQREMTLPLATREIDVIGIFRYQNTWPLCLEFLRSGKIDVKPLITHRFGFSQKEVEEAFETSARGGNAIKVMFNL

SEQ ID NO: 18979 - protein, 155 aa, Brassica napus
MGLQGQLSDVSSDSIPLMLLSLLAVFLGRLRSFLHRPCDPDSNLTVDDSSSIIASGLANIIVLADQLSLNRLFSYRCGGEGGGSDCVVCLSKLREGEEVRKLECRHVFHKRCLEGWLHCLNFTCPLCRSALVADGCVSKTQRRVGRDLISCLAPH

SEQ ID NO: 18980 - protein, 440 aa, Arabidopsis thaliana
MYLDINGVMIKQFSFKASLLPFSSNFRQSSAKIHRPIGATMTTVSTQNESTQKPVQVAKRLEKFKTTIFTQMSILAVKHGAINLGQGFPNFDGPDFVKEAAIQAIKDGKNQYARGYGIPQLNSAIAARFREDTGLVVDPEKEVTVTSGCTEAIAAAMLGLINPGDEVILFAPFYDSYEATLSMAGAKVKGITLRPPDFSIPLEELKAAVTNKTRAILMNTPHNPTGKMFTREELETIASLCIENDVLVFSDEVYDKLAFEMDHISIASLPGMYERTVTMNSLGKTFSLTGWKIGWAIAPPHLTWGVRQAHSYLTFATSTPAQWAAVAALKAPESYFKELKRDYNVKKETLVKGLKEVGFTVFPSSGTYFVVADHTPFGMENDVAFCEYLIEEVGVVAIPTSVFYLNPEEGKNLVRFAFCKDEETLRGAIERMKQKLKRKV

SEQ ID NO: 18981 - protein, 314 aa, Coccidioides posadasii
MASRHTTFRLNTGEDIPAIGFGTWQDENAQEDAVLTALSAGYRHIDTAAVYGTEKAIGRALARSRLSRDELFITSKLWNNKHRPEDVEQAIDQSLKNLEIDYLDLYLMHWPAAFAPGDDMFPKDSQGNSKTVDIDYVDTYKAMEKLVKSGKTKAIGISNFSKGEMERLLESCSIVPAVMQMELHPWLQQNDFVEWLKSKGIHVTQYSSLGNQNEVYSGRERYGRLIEDPALAAIGTKYGKTGAQVALAWGITKGHSVLVKSKTPHRIQQNFESDFELKQEDMKAIENIDKKLRFNDSSADFGYNFFVGLEGKEK

SEQ ID NO: 18982 - protein, 256 aa, Candidatus Protochlamydia amoebophila UWE25
MIDGNIIRKIVRASDVQPGNLVLEIGPGPGSLTQAMLEVEAHVVAVEKDFVLARELKRFQTPSKQLEIFCEDILMFSVEEELQSRLRDDQKAKVIANLPYHLTTPILAEMVVRRKLFSSLTVMVQEEVARRMTALPGQSDYSSFTIFLNFYSKPRYGFTVSRNCFYPAPKVDSAIVVLELKEPPPNIDAQVFFKITRTAFEQRRKMLRASLKSLFDPSKISNALEIIGQNPQARPEVLSLEDFIKLYHELYSSERH

SEQ ID NO: 18983 - protein, 322 aa, Streptomyces avermitilis MA-4680
MPKTQSGTSNRTRSTTAGGSARGKWNAGDIPDQTGRTAVVTGANSGLGIATVEALARAGAHVVLAVRDLERGEAAAAGVHGSVEVRRLDLADLASVREFAAGWQGDLHLLINNAGVMNIPEASTKDGFEMQFGTNHLGHFALTNLLLPRIKDRVVTVSSGAHRMPGSPYIHFDNLNLTGEYAPLTAYSQSKLANLLFTLELQRRLAEAASPVRALAAHPGWAATNLQSHDGSALRRALMRVGNRFIAQDNRAGALPTLYAAVQDLPGASYVGPDGFGEMRGGPTLVGRSAAAGDPVSARRLWTASEDLTGVTFPRLTAAVSA

SEQ ID NO: 18984 - protein, 339 aa, Glycine max
MDHSADAQRTDLMTITRFVLNEQSKHPESRGDFSILLSHIVLGCKFVCSAVNKAGLAKLIGLAGETNVQGEEQKKLDVLSNDVFIKALISSGRTCILVSEEDEEATFVEPSKRGKYCVVFDPLDGSSNIDCGVSIGTIFGIYLIKEDHEPTVEDVLQPGKNMLAAGYCMYGSSCTLVLSTGSGVNGFTLDPSLGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYSADEK

SEQ ID NO: 18985 - protein, 93 aa, Triticum aestivum
  misc_feature (7)..(7): Xaa can be any naturally occurring amino acid
  unsure (1)..(93): unsure at all Xaa locations
SGGQSEXSATAHLNAINQVKALKPWALSFSYGRALQASVLKAWKGKPENVAAAKDALMHRAKMNSLAAVGKYEASMETSAADAGSLHVANHQY

SEQ ID NO: 18986 - protein, 66 aa, Taraxacum officinale
NSGGGGGAGSGGNDVELLSKTLQVEHKLFYFDLKENPRGRYLKISEKTSATRSTIIVPFNGISWFF

SEQ ID NO: 18987 - protein, 225 aa, Photobacterium sp. SKA34
MNQISLLAEFGSPITRVENALNALRRGLGVMLLDDENRENEGDLIFSAEHITATQMALMIRECSGIVCLCLTEKHVKQLDLPAMVENNNSANKTAFTVSIEAKEGVTTGVSASDRVTTIKTAIALNAQPSDLARPGHVFPLCANEKGVLGRRGHTEGTIDLMTLAGLEPVGLLCELTNIDGTMAKADEVVYFAKQHNMPVLTIEDIVAYRLQQKKDKSQELEMVL

SEQ ID NO: 18988 - protein, 497 aa, Thermoplasma acidophilum
MGFHDYIEETKNIFNRLYPDNKITDIDYEGPTIVVYTKDPELFAKRDDLVRQIAQEIRRRIAIRSDPSILLPEDQARESIEKIIPKEAGLEDIYFEPDTGEVIIELDEPSIVTARGTDYVQEIKSRTQWSPRIVRAPPMYSRTVKEVREFMREVKQERREFLHNLGVKLSGPPMVGETWVRLTALGGHSEVGRSATLVSTKNSKVLIDCGMMNVGPDADPWDAAPYLYVPEVQPLSTIDAVILTHAHLDHSGLLPLLFKYGYDGPVYMTPPTRDLAALLQNDYIKVARMEGGKVPYESKYIREELKHTITLRYGETTDITRDMRLTFYNAGHILGSASGHLHIGDGLYNVVLSGDVKFEKTWLFNPANNKFPRAETFMTESTYGGRDDYSFTREEATQTLIDVINRTHDRGGSVLIPVFAVGRSQEVMIVLEDAMRNGRIPQMDVYLDGMIMEAPAIHAAYPEYLNKELREAIMVKKENPFLSPIFKKVETRDRGRK

SEQ ID NO: 18989 - protein, 385 aa, Yarrowia lipolytica CLIB122
MNAIDKHYTQKPTDKNLSAKFDSILPDTAVYRKLQDLERRMDATFTRKRLDLGDLQARMLKQKKTLRLFVSNTAAHQAWQIDPDNMGDFQPPSWTLNIEGNVEGEDKPFSSYFTSISVEVNGEIVEWHEPQGERPAPTEELAGDVTGKDVGFDVFKMTREGSGQIPARIVLQLKEYPDRARLSEPLSEILALDEASKSDIILALWQYIKFHDLQQTEEKRNIKCDEPLRQLFGRNTVTFPEIMELITPHLLPKEPLVINYTIDTDVENNLGETVFDLALEFDDDINAEIGKITKHWFDNQEDIFKLDEHIALIIQQLNNTRLKREFFKQFAANPSDFLSKWNSSQARDLKLLSGDRGFNEEEVRKSSFYTDEFMGESAHLLLARR

SEQ ID NO: 18990 - protein, 306 aa, Zea mays
MDGGGGGGGGGGGVGAGVMVGGGVVPGGGGGDVELVSKTLQFEHKLFYFDLKENPRGRYLKISEKTSATRSTIIVPIDGVAWFLDLFDYYIRTDERDVFSKELRLQTKVFYFDIGENKRGRFLKVSEASVNRNRSTIIVPAGSSGEEGWEAFRSVLLEINNEATRLYVLPNHPNQQHMEPPERLPGLSDDVGAGFIAGHGSQSASGPEVDVERLVDLPPQEEISGMGMSKVIRADQKRFFFDLGSNNRGHYLRISEVAGVDRSSIILPLSGLKQFHEMVGHFVDIMKDRLEGMTGANVRTVEPSQR

SEQ ID NO: 18991 - protein, 478 aa, Magnaporthe grisea 70-15
MALPPKVYQWLIGVFASLGSATYGYDLGIIAQVISAPSFVKRVGDNPAEIGGIVSIFTGGAFFGALAAAPTADRLGRKLCIMMGATIFIAGGLLQALAQSTAYMMAGRGIGGVGIGAMIMIIPVYQAELTHPSIRGTVTALQQFMLGVGALFAGWFSYGMTVGVSDDDENQWRISLGLQVVPAGVLALLIMLFPESPRWLIDHGRADEGLQTLARLHAHGDVDDAWVRAEYSQIRESIDAEHEAEAKSYAELFRDRSCLRRLWLAASIQASVQMTGVSSIQYYSVAIFAKMGISGSDTLKYQGISGVWALVAQALCMAFVDRLGRRWPLILGNAFNCISFIVTTALLASFPPGESGGNMSASWAFIVMTWLYNFSFSATCGPLSWIIPAEIFDMKTRAKGVSIATAVCNATNAIYFWAVLPETARRPLEEMRYLFTEAPFFIPTMDPSRAYSNDLADRLEQAERKQDAAVEGRDETHV

SEQ ID NO: 18992 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCRRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 18993 - protein, 79 aa, Cucumis melo
TGAPVYLAAVMEYLAAEVLELAGNAARDNKKNRIIPRHVLLAIRNDEELGKLLAGVTIASGGVLPNINPVLLPKKTDKG

SEQ ID NO: 18994 - protein, 223 aa, Cucumis melo
MAAAPSVREENVYVAKLAEQAERYEEMVEFMEKVSASLDKEELTVEERNLLSVAYKNVIGARRASWRIISSIEQKEESRGNDDHVSVIRDYRSKIETELSNICDGILKLLDSRLIPSAASGDSKVFYLKMKGDYHRYLAEFKTGAERKEAAESTLTAYKAAQDIANAELPPTHPIRLGLALNFSVFYYEILNSPDRACSLAKQAFDEAIAELDTLGEESYKDS

SEQ ID NO: 18995 - protein, 326 aa, Bacillus cereus E33L
MQSTIRKQLLQVFSEADGEFVSGQTISDKLGCSRTAVWKHMEDLRNEGYELEAVRRLGYRIASKPDKVTANEIQLGLQTKHIGRTVYFEESVESTQHIAAKLAYEGAEEGTIVVAEEQTAGRGRLSRKWHSPKGTGIWMSIILRPSIPVHHAPQLTLLAAVSVAQAIEKCTGVNVGIKWPNDILIQGKKAVGILTEMQADPDKINAVIMGIGINANQKQEHFDEEIQHIATSLAIESGKLIVRAELMQQIFLQLEKLYEEYLQNGFSVIKILWESYAVSIGKEINARTMRETITGVAKGITEDGVLLLEDHEGKVHHIHSADIEIK

SEQ ID NO: 18996 - protein, 559 aa, Mycobacterium sp. JLS
MRKIETGDLWWKNAVFYCADIETFYDWNGDGTGDIRGMTERIEYLFDLGVTCLWLMPFYPTARKDDGYDIIDFFGVDQRLGNLGDFVELVRTARSKGIRVIVDFVMNHTSDAHPWFKSARRSKDDPYRDYYVWSETEPKSSPADVVFPDQEDSIWEQEPKTGEWYLHHFYKHQPDLNIANPKVQEEISRTLGFWLQLGVSGFRVDAVPFLFARDGVPGDPGVFDPYEYLGDVRNFVNRRVGDAVLLGEVNVPYDDQKSFFGGPDGDGLNMQFDFIGMQNMYLSLARGDAGPIAAALRERPPLDETSQWANFVRNHDELTLDKLGDAERQEIFDAFGPEPDMQLYGRGLRRRLPAMLGGDERRMRMVYSLAFSLPGTPVLYYGEEIGMAENLDIPGRFAVRVPMQWTSDDNGGFSRAAARRLPRPITDGLYGPDRVNVADQRHDHQSFWWFIRDLIYTYRQQPEIGWSTAEVLDQPNPAVLAHCCREKSGWTMVGLHNFGADRCMVPIQIEDAPEGSTLVDLLDGLSVHELDAKGRLEIGLDGYGYRWLRLVRPGDDPII

SEQ ID NO: 18997 - protein, 306 aa, Hevea brasiliensis
MPSHGDLDRQIEHLMECKPLPEARGQTLCDQARAILVEEWNVQPVKCPVTVCGDIHGQFYDLIELFRIGGNAPDTNYLFMGDYVDRGYYSVETVTLLVALKVRYRDRITILRGNHESRQITQVYGFYDECLRKYGNANVWKYFTDLFDYLPLTALIESQIFCLHGGLSPSLDTLDNIRALDRIQEVPHEGPMCDLLWSDPDDRCGWGISPRGAGYTFGQDIAAQFNHTNGLTLISRAHQLVMEGYNWCQEKNVVTVFSAPNYCYRCGIMAAILEIGENMAQNFLQFDPAPRQIEPDTTRKTPDYFL

SEQ ID NO: 18998 - protein, 361 aa, Triticum aestivum
MAGRLVLSVVVTLLAAAGAAAAESSCPATPPDAGPMLQVSHAFGPCSPLGNAAAAPSWAGFLADQSSRDASRLLYLDSLAVAGRAYAPIASGRQLLQTPTYVVRARLGTPPQQLLLAVDTSNDAAWIPCSGCAGCPTTTPFKPAASTSYRAVPCGSPACSRAPNPSCSLNTKSCGFSLTYADSSLEAALSQDSLAVANDVVKSYTFGCLQKATGTAAPPQGLLGLGRGPLSFLSQTKDMYEGTFSYCLPSFKSLNFSGTLRLGRKGQPLRIKTTPLLVNPHRSSLYYVGMTGIRVGKKVVPIPPSALAFDPATGAGTVLDSGTMFTRLVAPAYVAVRDEVRHRIRGANGRVGFAREQCTAA

SEQ ID NO: 18999 - protein, 95 aa, Triticum aestivum
MASGGGKATASSWAAAMSVGAGTVEALKDRHAGLCRWNQHAPPFVFQQRAGTSAACGKGKAATTAGGAAMRRKARQEQEEELRTVMYLSNWGPNN

SEQ ID NO: 19000 - protein, 1898 aa, Candida glabrata CBS 138
MLKGSNSKSSDGSGSGSNSGLFQNLRRLTTKDRDNRNKSPKRTSLDNDNISQRSTKNINVSQAVSSRHGSIDQSRPLNKKSTLNSQNLSQYVNNGKALSPESGSNHHRTDSTQSGFKYSYSRRSSGQVSMAPSSMGNINLTRHNTNTSFSSASVLSHGSITNLSRFMTPDGKINLTMPSDPYEVESLFEDIMYKRNILQSLPQEKQNELMSYSIEKKWLIVKQDLQNEFKRIKASNKGDSRTGMSMPDLGSDPSNSVSPPGPISSSGSSIFSSDVTSTAPSTYSRSGKKNIPISKPIAATSTELYHIAERNTSSSTIQSDKANRPPIHYVKKIVDDKLSKDEMKDLWVTLRTEQLDWVDAFLENQGHIAMANILMKSIYKTTPKDKVSEPLLDKENAFFKCFRVLAVLSQGLHEFTIHSLMTDTIAQGLFSGRLATRKMATEIFVFLLEKKNKKRFESVLSSLDKNFIIGQNSHMNESYKKLPQYFTHLTSNSNLKVIQAWLFAVEQTLDGRGKMGSLVGASEDYKNAGGENAILEYCQWTMVFINHLCSSSENINQRTLLRRKLENCGILRIMNKIKLLDYEKVIDQIELYENNKLDDFNALLESNKKNINVDLQDPVSLMKNLLDACKGTENEKTLVSLVQHIFLPTSKLLDEKQDPNKVTKQLKLMDSLVTNVSVTSTEEGSNVNMAIQRLYDSMQTDEVARRAILESRTLTKKLEEMEAERDMLVEKLSKAEHGLVGQLEMEVKERDRILAKNQRVMKQLESELEELKKKHLLEKHEQEVELRKMLTILNSRPAKTKEQKKKIGSIEASEKEDLQRALQSGLQKAKKDFKDDSKKFGMTIQPNQRLKVLRMQMESIENEARKLEMTNFAEYEKKGLKPPANVQKKSKPISELNKEQRIQKLNELRDKLRRIQMESNDVSKFNVDERVNELFNDKKRTALQRLKELETKYKGFGIDFKVEDFTHESTDSSNEGYSSLDPKVYQDKLDEITKISEELLQQKNELETTQTSSSESNSDSESSSDSDDSMEDALTNNKDINGTSSNVSDLASGSFLDTLTQKYGTGQAEPIQSPVGHYSNRNEKSFVDRMKRNSRVPSYVEELSKKMRGNKDHEFEEDDHKNGNQSSDDFDSESKTNMDQDQLLATSAVSPTTSAPPPPPPPMPAGLFGANNDNNTGDSDAISVSGTPAPPPPPPPPPFLKDSSPIPPPPMPTMLTPSESTTSLSSIPPAPPMMTKDSKKKVVSSPLLPQSPSLFENYPRPQKKLKQLHWEKVESTDNSIWGSQKAEKFADDLYEKGVLSELEKAFAAREIKSLATRKKEDLQKISFLSHDISQQFGINLHMYSNLTVNQFVEKVLKCERDFMNTPSVIEFLSKQEIVEVSTNLARNYAPYSTDWEGIKKIEDAKAPEKDPNELQRADQIYLQLMVNLQSYWASRMRAIRMITSYEREYNELLAKLHRVDKAVGSLQGSDNLKNIFNVILAVGNFMNDSAKQAKGFKLSTLQRLTFIKDADNSMTFLNYVEKIVRSNYPEFNNFLIELEPVLEVVKVSIEQLVNDCNDFVQGINNVERSIEIGNLSDSSKFHPLDKVLLKVLPNLSEARKKGELLADEMKLTIMEFEQIMQTYGEDYGDKFAKISFFQKFADFIAEYKKAQAQNIKVEEEEAAYERHKKMVEEQQRKAQEDASKLNENSSQTGNSDEEEESEDRRAVMDKLLEQLKNAGQVKTDPTSARKRALLRKKIHSSEESESSPLAEMQVGGDSLIYSPDAKEQIELEIHMASPTPKTKEDGKLGTGENSNGESPLKKINEDEEIGDRAKTLLMELRGSDALMDRNTALDEHKERLRARRKRTDSNKIPSSNRLKFVDEKSPDEEQEEVSSSSISTTGIVTAQESPVQIDENED

SEQ ID NO: 19001 - protein, 454 aa, Lactobacillus johnsonii NCC 533
MEKFQSKKLDHEKVLRDPVHNYIHVKDQVILDIINSKEFQRLRRIKQLGPASYVFQGATHTRFEHNLGVYELTRRICDIFEEKYVSKEPGDGLWNPDERLLAECAALLHDIGHGPYSHTFEHLFGTNHEKMGQQIITDKNTEVNQALRKVSPNFPELVASVIAKTYPNPQVVKLISSQADADRMDYLLRDAYFTGVTYGSFDLTRILEVIRPYRDGICFTDKGIHSVEDYIISRYQMYQQVYFHRVNRSMEVILHHLLERAQIIYEEGKLQVTPQLEAFLNGKWTLEDYLKLDDGVMETNFLLWTNSGDQILSDLSNRYLYRHPLESVKINEDTKSLLPKLKNLIKQAGFDPNYYTATNSAFDEPYDAYKPTGKNAHSPIEIMQADGSLVELSELSPLVKSLNGTLQGDERFFFPKVMVKETDEPQIFDPIYQEFQKYIRNNTLRYLRRPNKKK

SEQ ID NO: 19002 - protein, 222 aa, Zea mays
MSMFNRIFGKPKEQANSNALATLDKLNETLDMLEKKEKVLEKKANAELERAKEFSKAKNKRAAIQSLKRKKLYEQQIEQLGNFQLRIHDQMIMLEAAKATTETVDALRTGAAAMKAMQKATNIDDVDKTMDEINEQTENMKQIQDALSAPLGAFADFDEDELEAELEELEGAELESQLLEPVAAPPVHPVHVPANKQPARPAPQKVTAEDDELAALQAEMAL

SEQ ID NO: 19003 - protein, 137 aa, Streptococcus pneumoniae TIGR4
MSRKPFIAGNWKMNKNPEEAKAFVEAVASKLPSSDLVEAGIAAPALDLTTVLAVAKGSNLKVAAQNCYFENAGAFTGETSPQVLKEIGTDYVVIGHSERRDYFHETDEDINKKAKAIFANGMLPIICCGESLELRSW

SEQ ID NO: 19004 - protein, 120 aa, Streptococcus pneumoniae TIGR4
MNYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 19005 - protein, 544 aa, Magnaporthe grisea 70-15
MTPQGLLAVCTGLLLLKIFISFVSRYRRHQILIRQHGCLPPPKAKLKDPIFGIDVILSNGRAAREHRSLQTFEERFYSIGATYSTKHGFPLIITMEPDNVRAVINQNFHDYALAPFRQPALKHFLGDGIFTTDGEKWHSSRALLRPNFNRDQIANLEAIETHVKDLFALLPRDGATPVDLKGLLLRFTMDSTTEFLFGQSVYSLRRNGARDGDSLEAQFETAFTGAQAECMEFIGMGPLARFARVNSQKQVEIVHRYIDKFVDRAIAFRKEYGKQGHRSESSLTGFVPGPAYSQPGYPCHAFRKEYEAGGGGPIGTGKEKPKYLFLQELAKQTTDRTRLRSELLNILMAGRDTTASLLGNLFFMISKSPEIMAKLQQEVDSLNGARPSYSSLRDMKYLKYCLRESLRLHPVAPVNTRIAVTDTVLPRGGGPDGSKPVLVPKGTAVGWSVYAMHRRKDLYGPDADRFRPERWETLNTRSEYLPFNGGPRICLGQQYALTEASYVTVRMLQEYEMESRDPGEWEEELAITACNRRGCLVALKARSE

SEQ ID NO: 19006 - protein, 412 aa, Zea mays
MAAESHLDEPLLLRGGSFGDVSFWRSCLNLSNVISGVGLLSVPYALAQGGWLSLVLFAVVGAVCYYTGELIARCMRAGGDDIRSYPDIGYLAFGRLGRKAIGAVMYIELYLVAISFLILEGDNLDKLLPGTAVGLPGGYVLRGKQLFTLAAAVVILPTTWLRDLCVLAYVSAVGLVASVALTASLVWAGVAEHGFHAAQDGNLFSLAGLPTSLSLYFVCFSGHGVFPTVYTSMRNKQDFTKVLLASSVLCSLNYALTAVLGYMIYGDDVKSLVTLNLPSGKAYTRIAILTTLITPLAKYALVIQPIMTGIEEKLPPRARQGRLTRAAISTAVLVSTVVAACTVPFFGYLMSFIGSSLNVTVAVLFPCLSYLRVGRVRRRSEAAWIVAILVFGLCVAVKGTYASLHQILSTFW

SEQ ID NO: 19007 - protein, 419 aa, Prochlorococcus marinus subsp. pastoris str. CCMP1986
MNNKRIFHDPIHKEIIIDSDKPEELMIMQLIDTLAFQRLRRIKQLGAASLLFHGAESSRFTHSIGVFCVARKIYRKLVEINPDFSQNKFILFGAALLHDLGHGPLSHTSEVIFAHDHELWSKNLVKNYSPISSILKNFGTELPNQIGDLFKTKNLFSRPLKTLISSEIDCDRLDYLLRDSYNTGTKYGLVDLERIISALTFSPDGNIAIKPKGVIAIEHFLVLRNMMYRTIYNHRINEISTWILEKIIQIIKKDSVKKDLWIDESMRRWIFFPNQLEVKDFLANDDIVFYFHLMKWKEESFEPLKTLCKMFIDRKLLKASDISFLTKLKRLEILAFARKKCKLNNYDSEIFCGIKERSFKGFKSDNSLKIWDGTYQNLLENQSDLINTLMSSKDTSLIIYPGEFRKEIEDQIAIERANV

SEQ ID NO: 19008 - protein, 975 aa, Burkholderia vietnamiensis G4
MKHEHPDRLMNRTPLSLAALETHDAFAERHIGPDAASQQAMLDTLGFASRAALIDAVIPASIRRAEALPLGPFAQPKSEAEALAALRALADKNQVFRSYIGQGYYDSHTPAVILRNVLENPAWYTAYTPYQPEISQGRLEALLNFQQMVVDLTGLAISNASLLDEATAAAEAMTLLQRTGKPKSNVFYVADDVLPQTLEVVRTRALPIGIEVKTGPAAEAAQAGAFGVLLQYPGVNGDVRDYRALTDAIHAAGGHVVVAADLLALTVLTPPGEWGADVAVGNTQRFGVPMGFGGPHAAYMAVRDEFKRQMPGRLVGVTVDAQGKPALRLALQTREQHIRREKATSNVCTAQALLAIMASMYAVYHGPHGLKTIALRVNRIAALLAAGVKQLGFTTVNDTFFDTLTIDAGARTAQLHAFANAKRINLRRVSDTQVGVSVDETTTRDDLADLLAVFAQAAGGTAPDVDALDAGLPGVAALPAGLERTSAYLTHHVFNRHHSETEMLRYLRSLSDKDLALDRSMIPLGSCTMKLNATSEMLPVTWPEFGRIHPFAPSEQTAGYREMIDQLEQMLVAATGYAAVSLQPNAGSQGEYAGLLVIHAYHASRGEAHRDVCLIPASAHGTNPASAHMAGMKVVVVACDAQGNVDIADLKAKAEQHANDLAAIMITYPSTHGVFEQNVREICEIVHAHGGQVYVDGANMNAMVGLTAPGQFGGDVSHLNLHKTFCIPHGGGGPGVGPVAVGPHLAKFLPNQRSTGYARGEEGIGAVSAAPYGSASILPISWMYIAMMGAKNLTAATETAILNANYIAKRLAPHYPVLYSGPGGLVAHECILDLRPIKETSGITVDDVAKRLMDYGFHAPTMSFPVPGTLMVEPTESESQEELDRFIAAMIAIREEIRAVEEGRADREDNPLRHAPHTAAVVTANEWPHAYSREQAAYPVASLVTNKYWPPVGRADNAYGDRNLFCSCVPMSEYA

SEQ ID NO: 19009 - protein, 228 aa, Staphylococcus aureus subsp. aureus MRSA252
MPKLILCRHGQSEWNAKNLFTGWEDVNLSEQGINEATRAGEKVRENNIDIDVAFTSLLTRALDTTHYILTESKQQWIPVYKSWRLNERHYGGLQGLNKDDARKEFGEEQVHIWRRSYDVKPPAETEEQREAYLADRRYNHLDKRMMPYSESLKDTLVRVIPFWTDHISQYLLDGQTVLVSAHGNSIRALIKYLEDVSDEDIINYEIKTGAPLVYELTDDLEVIDKYYL

SEQ ID NO: 19010 - protein, 279 aa, Bacillus anthracis str. 'Ames Ancestor'
MKNLQSKAVLNNGVEMPWFGLGVFKVEEGPELVEAVKSAIKAGYRSIDTAAIYGNEKAVGEGIRAGIEATGISREDLFITSKVWNADQGYEETIAAYEESLKKLELDYLDLYLVHWPVEGKYKDTWRALETLYKEKRVRAIGVSNFQVHHLQDVMKDAEIKPMINQVEYHPRLTQKEVQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 19011 - protein, 186 aa, Azotobacter vinelandii
MIPVILSGGSGSRLWPLSRKQYPKQFLALTSERTLFQQTLQRLNFEGMQSPIVVCNQEHRFIVKEQLEAIGLNIQGLLLEPFGRNTAPAIALTAMKLLAEGRDELLLILPADHVIADQQAFQQALKVAAQAAEMGELVLFGIPAHSPETGYGYIKCDLAVQGTLPEGSNRVLQFVEKPDLAAPANS

SEQ ID NO: 19012 - protein, 526 aa, Candida maltosa
MTSDSTIHELIQSYITKWYVIVPLAIIIYKVFDYFYVLSLRKRLGAAVPTNEETDGYFGFHLPFVLMSKKKDGTIIDFSIERYPELKHPETPTFEFPIFTVKLISTIDPENIKAILATQFSDFSLGTRHAHFAPLIGDGIFTLDGAGWKHSRAMLRPQFAREQVGHVKLLEPHVQVLFKHIRKNKGREFDLQELFFRFTVDSATEFLFGESVESLRDASIGMTSKSKDVDGIEDFTGAFNYSQNYLASRSIMQQFYWILNGKKFRECNAIVHKFADHYVQKALNLTEADLEKQAGYVFLYELVKQTRDPQVLRDQLLNILVAGRDTTAGLLSFVFFELARNPDVVAKLKDEIDTKFGLGEDARIEEITFESLKQCEYLKAVLNECLRLYPSVPQNFRVATKNTTLPRGGGKDGLSPILVRKGQTVMYSVYATHRMESVYGKDATTFRPERWFEPETRKLGWAFVPFNGGPRICLGQQFALTEASYVTVRLLQEFSTLTLDPNLEYPPKKMSHLTMSLFDGTNVQMY

SEQ ID NO: 19013 - protein, 520 aa, Coccidioides immitis RS
MTKVDQKVALIVIDGWGVPGPQSPPEGDAIAAAETPVMSSFADPKAKTAQGYTELDASSLAVGLPEGLMGNSEVGHLNIGAGRVVWQDVVRIDQTLKKGELNKVQSIVNTFNRAKTGNGRLHLLGLVSDGGVHSHINHLVGLLKVAKEMEIPKVFIHFFGDGRDTDPKSGAGYMQQLLDSMKEVGIGELATVVGRYFAMDRDKRWDRIEVAMKGIVLGDGEASDDAVKAINERYEKGETDEFLKPIIFGGDERRVKDDDTLFFFNYRSDRVREITQLLGDYDRSPKPDFPYPKNIAITTMTQYKTDYTFPIAFPPQHMGNVLAEWLSVKGLKQCHIAETEKYAHVTFFFNGGIEKQFEGEDRDLIPSPRVATYDLDPKMSAAPVGEKMAERIAEKKYDLVMNNFAPPDMVGHTGVYEAAIQGVAATDKAIGRIFESCKENGYILFITADHGNAEEMKNGDGSPKTSHTTNKVPFVMANAPEGWSLKEKDGILGDVAPTILDAMGIEQPKEMSGSSLLIRN

SEQ ID NO: 19014 - protein, 538 aa, Candida maltosa
MPVSFVHNVLEVVTPYVEYYQENLTKWYILIPTILLTLNFLSILHTKYLEYKFNAKPLTNFAQDYSFGVITPLMLMYFKWHGTVMEFACNVWNNKFLVLNGNVRTVGLRIMGLNIIETTDPENVKAILATQFNDFSLGTRHDFLYSLLGDGIFTLDGAGWKHSRAMLRPQFAREQVAHVKLLEPHVQVLFKHVRKSQGKTFDIQELFFRLTVDSSTEFLFGGSVESLRDASIGMTPSTKNIAGREEFADAFNYSQTYNAYRFLLQQFYWILNGSKFNKSIKTVHKFADFYVQKALSLTEADLEKQEGYVFLYELAKQTRDPKVLRDQLLNILVAGRDTTAGLLSFLFFELSRNPTVFEKLKEEIHNRFGAKEDARVEEITFESLKLCEYLKACVNEALRVYPSVPHNFRVATRNTTLPRGGGKDGMSPIAIKKGQNVMYTILATHRDPNIYGEDANVFRPERWFEPETRKLGWAYVPFNGGPRICLGQQFALTEASYVTVRLLQEFHTLTQDADTRYPPRLQNSLTLSLCDGANIQMY

SEQ ID NO: 19015 - protein, 257 aa, Methylococcus capsulatus str. Bath
MRHVPRKRFGQNFLRDPGVIQEIVAAVGPAPSDRLVEIGPGEGVLTRELLQSGACLEAIELDRDLVAALKRRFAGVGRLRIHEGDAMKFDLRTIATGERLRVVGNLPYNISTPLLFHLFDQIDVIEDMHFMLQKEVVDRLCAGAGDDHYGRLSVMAALYCQAQHLFDVGPECFHPQPKVVSAVVRLVPHAVPPDAGMVKQVSAVVVAAFGQRRKTLRNALKGLLDETAMVRAGIDPGARAEELSLADYVGLSRQLNP

SEQ ID NO: 19016 - protein, 165 aa, Aegilops speltoides
VMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 19017 - protein, 715 aa, Arabidopsis thaliana
MAVSLPLFQFILFLLLLLLSRTVYAYLIGVGSYDITGPAADVNMMGYANSDQIASGIHFRLRARAFIVAEPQEKNVAISGIHTHAGPGGYLQYVTYIVTSLGFVRQSFDVVVNGIEQSIVQAHESLRPGSAFVNKGDLLDAGVNRSPSSYLNNPAAERSKYKYDVDKEMTLVKFVDSQLGPTGSFNWFATHGTSMSRTNSLISGDNKGAAARFMEDWFENGQKNSVSSRNIPRRVSTIVSDFSRNQSRLLDIAATYKSSRGHSVDKSLDVKTRVRNGSKRKFVSAFCQSNCGDVSPNTLGTFCIDTGLPCDFNHSTCNGQNELCYGRGPGYPDEFESTRIIGEKQFKMAVELFNKATEKLQGKIGYQHAYLDFSNLDVTVPKAGGGSETVKTCPAAMGFGFAAGTTDGPGAFDFKQGDDQGNVFWRLVRNVLRTPGPEQVQCQKPKPILLDTGEMKEPYDWAILRIGQLVILSVPGEFTTMAGRRLRDAIKSFLISSDPKEFSNNMHVVIAGLTNTYSQYIATFEEYEVQRYEGASTLYGRHTLTAYIQEFKKLATALVNGLTLPRGPQPPDLLDKQISLLSPVVVDSTPLGVKFGDVKADVPPKSTFRRGQQVNATFWSGCPRNDLMTEGSFAVVETLREGGKWAPVYDDDDFSLKFKWSRPAKLSSESQATIEWRVPESAVAGVYRIRHYGASKSLFGSISSFSGSSSAFVVV

SEQ ID NO: 19018 - protein, 164 aa, Aegilops bicornis
VMASSATSVAPFQGLKSTGGLPVSRRSRGSLGSVSNGGRIRCMQVWPIEGIKKFETLSYLPPLSTEALLKQVDYLIRSKWVPCLEFSKVGFVFREHNSSPGYYDSRYWTMWKLPMFGCTDATQVLNEVEEVKKEYPDAYVRVIGFDNLRQVQCVSFIAFRPPGC

SEQ ID NO: 19019 - protein, 293 aa, Medicago truncatula
MSQRITEEPLPTKTAQSTVTCLYQTSIGGQWRNISVLWCKNLINHTLNLKVDSARGEQFHQNCKIEVKPWCFWNRKGYRSFDVDGNQIDVYWDLRSAKFAGNCPEPCSDYYVMLVSDEEVVLLLGDYKKKAYKRMKMRQALVEATLLVKRENVFAKKSFSTKAKFDEKRKESDIVVESSTAGNKDPEMWISIDGIVLIHIKNLQWKFRGNQTVMVNKQPVHVFWDVYDWLFSVSGSGPGLFIFKPGPTEVESDKEEKGLEGESDDGSATSGYYSTKSYTPFESCLVLCAYKLE

SEQ ID NO: 19020 - protein, 486 aa, Aspergillus oryzae
MSTAPNLAYTAGPAMPVPMPQHPVPAQYIPAQRNMPHPNDAALRRSRKPTDKNIPDGIEDVVIGEGVQQYKNLRDLEKRLDAAIVRKRLDIQDSISKTVKKYRTMRIWITNTVENQPWQGATGQNGSATNPGSGRYKVRIEGRLLDDDTDPTAPEDSDNEGNETQANGDAMDHDGKDAKKNAPKRSKQRFSHFFKTITVDFDKSSTANPEEVKTVNWTKPQLPANTVTLPPTADFDSLQFSRASQENLNVTVSLVRDETPERYKLSKDLAEVLDVEEETRSGIVLGIWDYIRAMGLQEDEEKRLVRCDHRLRSIFGRDQMFFPQIPESIGHHTSPLDPIKLPYTIRVDEEFHKDPTPTVYDIQVAVEDPLRAKMLALTQNPQYTAGLRQISTLDDQVSLIVQALTHSRAKHSFYTALSKDPATFLRRWVNSQRRDLETILGEATRGGGEDATGPEFRRGGADGAWDSPVALEAVRYMLAKPEAMLR

SEQ ID NO: 19021 - protein, 424 aa, Aspergillus oryzae
MAPSSTTAQRIEEARALAKKDASKAETIYKDILSKGPGSTEASSRDYESALVGLGELYRDEKKPNEIAELIKTSRDSFSSFAKAKTAKLVRQLLDLFSEIPNTLDIQTAVIKSCIDWAIVERRSFLRQNLQTRLVAIYMQKQAYYDALNLINSLLRELKRLDDKLMLVEVQLLESRVYHALGNQAKGRAALTASRTSAASVYTPPNLQAGLDMQSGMLHAEDKDFTTAFSYFIEALEGYSSLDESDKATAALQYMLLCKIMLNLGDDVTTLLGSKQAQKYASPRLEAMKAVARAHANRSLEEYEKALSDYRFELGRDVFIRNHLRRLYDAMLEQNLIKVIEPFSRVELDHIAKMVGLDTPQVERKLSQMILDKVIIGVLDQGSGCLIVFDETERDQAYDAALETIEKLSNVVEELYTNQASQLE

SEQ ID NO: 19022 - protein, 142 aa, Triticum aestivum
MLCIRTYVRMCGQKTIASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLASREAAYYQQGARFAQWRT

SEQ ID NO: 19023 - protein, 375 aa, Prorocentrum minimum
MASEITALVVDNGSGMCKAGFSGADAPRTVFPSIVGRPKMPSIMVGMDTRDSYVGDEAMSKRGILSLRYPIEHGMVTNWEDMEKIWHHTFYNELRVNPDEYPVLLTEAPLNPKANRERMTQIMFETFNVPAVYVAIQAVLSLYASGRTTGIVMDSGDGVSHTVPVYEGFALPHAIERLDLAGRDLTEYLTKILTERGYSFTSSAEKEIIRDVKEKLCYVAMDFDAELKAATESSDRERTYELPDGILIAVGSERFRCAEVLFQPSLVGKEASGVHEATFRSIMQCDIDVRRALYANVVLSGGTSMFPGMGERMTRELSALAPPTMKVKVIAPPERKYSVWIGGSILSSLSTFQQMWVSREEYDESGPGIVHRKCF

SEQ ID NO: 19024 - protein, 480 aa, Neisseria meningitidis MC58
MKQLAMYINGRFENDFNGEWRDVLNPSTEEAIAREPKGGKADVDRAVAAARAAQPAWERLPAVERGAYLRKIAQGIRERADELTDTIVAEGGKTKDLARVEVMFTADYLDYQAEWARRYEGEIIQSDRPRENILLFKRPLGVIAGILPWNFPFFLIARKMGPALVTGNTIVVKPSSVTPINCHIFAEIVDAVGLPAGVFNVVNGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGALEMGPLIEERAVKAVAEKVERAVKQGAKLVCGGKRAEGRGYFFEPTLLTDTDNSMDIMKEETFGPVLPVSAFDTLDQVIALANDCEFGLTSSVYTTNLNEAFYVTRRLQFGETYINRENFEAMQGFHAGWKKSGIGGADGKHGLEEYLQTQVVYLETDI

SEQ ID NO: 19025 - protein, 416 aa, Triticum aestivum
MAALSVPLRTAAALSSSGAGSRAAADPSKVSCVRSTRSAHFDCSFPSIAASSSSARNIEPLRAIATQAPPAVPQYLSGEKTKVGINGFGRIGRLVLRIATSRDDIEVVAVNDPFIDAKYMAYMFKYDSTHGPFKGSINVVDDSTLEINGKKITITSKRDPAEIPWGNFGADYVVESSGVFTTIDKASVHLKGGAKKVVISAPSADAPMFVVGVNEMSYDPKMNVVSNASCTTNCLAPLAKVVHEEFGILEGLMTTVHATTATQKTVDGPSMKDWRGGRGAGQNIIPSSTGAAKAVGKVLPELNGKLTGMAFRVPTPNVSVVDLTCRLEKSASYDDVKAAIKAASEGALKGILGYTDEDVVSNDFVGDTRSSVFDANAGMGLSSSFMKLVSWYDNEWGYSNRVLDLIAHMALVSAKH

SEQ ID NO: 19026 - protein, 89 aa, Glycine max
MSSASRTWAVAASVGVVEALKDQGLCRWNIALRSAQHQVKNHVRSLSQEKKVSSSSSSAVVSSRLKEEGAKQSEESLRKVMYLSCWGPN

SEQ ID NO: 19027 - protein, 298 aa, Thermotoga maritima MSB8
MGSDKIHHHHHHMQVPKVTLNNGVEMPILGYGVFQIPPEKTEECVYEAIKVGYRLIDTAASYMNEEGVGRAIKRAIDEGIVRREELFVTTKLWVSDVGYESTKKAFEKSLKKLQLEYIDLYLIHQPFGDVHCAWKAMEEMYKDGLVRAIGVSNFYPDRLMDLMVHHEIVPAVNQIEIHPFYQRQEEIEFMRNYNIQPEAWGPFAEGRKNIFQNGVLRSIAEKYGKTVAQVILRWLTQKGIVAIPKTVRRERMKENISIFDFELTQEDMEKIATLDEGQSAFFSHRDPEVVKWICSLKR

SEQ ID NO: 19028 - protein, 273 aa, Triticum aestivum
  misc_feature (125)..(125): Xaa can be any naturally occurring amino acid
  unsure (1)..(273): unsure at all Xaa locations
MGGLSMEHPWAFAFGLLGNVISFSSLLAPIPTFYRIFKSKSTEGFQSVPYVVALFSAMLWIFYALVKTGEGLLISINAAGCVIETVYIVMYLVYADRKAKIFTAKIVVLLNIAGFGLIFLLTLFXSHGETRVVSLGWICVGFSVCVFVAPLSIIGRVIKTKSVEYMPFTLSLTLTLSAIVWFLYGLLIKDKYVALPNILGFTFGVIQMVLYVFYMNKTPMASQVKEGKEAWKAPAGGPRRRDQRRQGRQELVRRGAPGHRDGRRRRRPQEMRC

SEQ ID NO: 19029 - protein, 262 aa, Silicibacter sp. TM1040
MSGDLSPIDKAKFVAAKRAAELVEDGMRVGLGTGSTAAWLVRCLGEMVREDGLKITGVPTSARTAELAREVGIELITLDEARWLDLTIDGADEFDSELNLIKGGGGALLQEKIVATASDQMVVIADKAKEVETLGAFPLPIEVIPFGWQTSQALVEETLISMDVMGRSSTLRMNGASPYVTDEGNHILDLHLNRIGNPRQLALVLNQIPGVVENGLFIDICDTVVIGYGDGKVEVRDINEGTIETDRIDFVETDNLFADLND

SEQ ID NO: 19030 - protein, 311 aa, Robiginitalea biformata HTCC2501
MERDNVDVVAINDLLDVEHLAYLLEYDSVHGRFNGTIAVKDGNLVVNGKTIRVTAERDPANLKWDEVGADIVAECTGIFTTLDMAQKHLDGGAKKVVISAPSKDAPMFVMGVNHQDAKASDKIVSNASCTTNCLAPIAKVLNDSFGIAEGLMTTVHATTATQLTVDGPSKKDYRGGRSAMLNIIPAATGAAKAVTKVIPALEGKLTGMAFRVPTADVSVVDLTVKLEKDTSYEEVKQAMKTASEGPLKGILGYTEELVVSQDFVGDTRTSIFDADAGIELNSKFFKVVSWYDNEAGYSNKLVDLALHVHNL

SEQ ID NO: 19031 - protein, 241 aa, Arabidopsis thaliana
  misc_feature (201)..(202): Xaa can be any naturally occurring amino acid
  misc_feature (213)..(213): Xaa can be any naturally occurring amino acid
  unsure (1)..(241): unsure at all Xaa locations
MKKVTSSKIPAKDDWVAVAITDDDLVVELLLRLKHAGTVVSDNPAVILPPLRWGIRQRRSRSSRFGGGGGVLVSLKKDVDSVRASPKTPLSWSGGSGSGGGSASPSADGFEDNSRQASCSTSTGSGSKVFPTNEITSCFSKRLKKRKSSFELKNEENLKLKERLDLEKEIASLRATFDEQNLRNQKLKRIKLDLNSGRVTXXRKPVDFDSENXQLGRLPGAPSCLRVWKGGFWGPPGFKWG

SEQ ID NO: 19032 - protein, 358 aa, Oryza sativa (japonica cultivar-group)
MSAFVGKYADELIKTAKYIATPGKGILAADESTGTIGKRLASINVENVEPNRQALRELLFTTPGAFQYLSGVILFEETLYQSTAAGTPFVDVLKAGGVVPGIKVDKGTVDIAGTNGETTTQGLDSLGARCAKYYEAGARFAKWRAVLKIGAAGEPSELAVKQNAEGLARYALICQENGLVPIVEPEILTDGAHDIKTCAAVTERVLAAVYKSLNDHKVLLEGTLLKPNMVTPGSDSPKVGAEVIGEYTVAALRRTVPPAVPGIVFLSGGQSEEEASQNLNAMNKLEVLKPWTLTFSFGRALQQSTIKKWGGKKENVAAAQAAFLARCKANSEATLGKYGGAAGDAATSESLYVKGYTY

SEQ ID NO: 19033 - protein, 473 aa, Streptomyces avermitilis MA-4680
MAAVTAAGAAQAPIVAGHPLLGSMNDLLNDPLATYLRARRDHGDVVRFRAGPPGLRADIYAVFSAEGAQQVLATESGNFRKDNVFYGELRDSVGNGLLTSQDATYLRQRRLVQPLFTRRRVDGYAGQVADEAAGLAEAWRGIPGGGVELVGEMHRFALRVVGRILFGTDMETTFEVIERTLPLLQEYALKRGLAPVRTPRTWPTPANRRAARTQAELFALCDGIIDSRRNRKNEGDGGEESGEDLVTLLVRAGNAEDGSLDAAELREQVLIFLLAGHETTATALAFALHLLARHPEQQRRVRDEADRVLGGPGGRAPTAADMEALPYLTMVLKEAMRLYPSAPVIGRRAVADAEVDGVRIPAGADLFVSPWVTHRHPDYWPDPERFDPERFTPEAEAGRPRYAWFPFGGGPRACIGQHLSMLESVLGLAVLIREFEFEAVGEEEVPLGAGITLLAKGPARCRVIPRSSGPRSS

SEQ ID NO: 19034 - protein, 165 aa, Aegilops tauschii
VMASSATTVAPFQGLKSTAGLPVSRRSSGSLGSVSNGGRIRCMQVWPIEGIKKFETLSYLPPLSTEALLKQVDYLIRSKWVPCLEFSKVGIVFREHNSSPGYYDGRYWTMWKLPMFGCTDATQVLNEVEEVKKEYPDAYVRVIGFDNLRQVQCVSFIAFRPPGCE

SEQ ID NO: 19035 - protein, 473 aa, Methylococcus capsulatus str. Bath
MPSPDRGPQELRRVLGWTSAGAIMAGSVIGTAIFLVPSTIVRELDSVGWTFFVWVLGGLLSLGGALSYAELGAAFPEAGGEYAFLRRAYGPLWGFLFGWQQVVIGKTGSIATIATGFALFLGFFVDGLQREWLHLSWGEVGWGVTGLQFVAMTAVASFSLINCFGVGRGGAVQSFLTVLKVAAIVALAVLVLGAGGGSWDHFRQAPEHPAWTGWGAFAAALAAVLWAYDGWNNLTLVGSEIRDPDRTIPRVFLLGLLGVMGVYLLANLAYFYALPPEALKRSERVAQDVAQLVFGDFGGAAITAAAVVSTLAALNGSILSGARVSYAMARDGLFFSPLARLHPVHRTPVNALIVQASFASFLILLFGQDRAGFDRLFNYAVFGLWAFYGITALAVIVLRRTSPEVVRPYRVAGYPWVPLIFFAVAGLFCLGMIFQNPSETAIGLVFLLLGIPFYLYWCSGGKAEAHRKSSPGE

SEQ ID NO: 19036 - protein, 165 aa, Triticum urartu
VMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHYSSPGYYDGRYWTMWKLPMFGCTDATQVLNEVEEVKKEYPDAYVRVIGFDNLRQVQCVSFIAFRPPGCE

SEQ ID NO: 19037 - protein, 468 aa, Aspergillus nidulans FGSC A4
MAGNAPKKLCLRPSGFARSTLVPRSRSIATSVSRRATEPTSYQATRLIPTDPTFSHFINKDSDVPETSAGLESEAEGVGRKIRHYTVNFGPQHPAAHGVLRLILEINGEEIVRADPHVGLLHRGTEKLIEYKSYFQALPYFDRLDYVSMMTNEQCYSLAVEKLLNIEIPERAKYIRTMFGEITRILNHLMSVLSHAMDVGALTPFLWGFEEREKLMEFYERVSGARLHAAYVRPGGVSQDLPLGLLDDIYQWATQFGDRIDETEELLTDNRIWKARTQGVGVVSAADALNMSFTGVMLRGSGVPWDIRKSQPYDAYDKVEFDVPVGVNGDCYDRYLCRMEEFRQSLRIIHQCLNQMPAGPVRVEDYKIMPPPRAAMKENMEALIHHFLLYTKGYAVPPGETYSAIEAPKGEMGVFLVSDGSERPYRCKIRAPGFAHLGGFDQIARGHLLADAVAIIGTMDLVFGEVDR

SEQ ID NO: 19038 - protein, 165 aa, Triticum timopheevii subsp. armeniacum
VMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 19039 - protein, 368 aa, Candida glabrata CBS 138
MDMDMDVPMHDAVDQLTPTEGNAEAANDSIGDEVDEAFKDAHPSQGAVLDSGKGGNKGFELNSSNINQLDQWIEHLGKCEILSEDDVSKLCKMAVEVLQFEENVQPINVPVTICGDVHGQFHDLIELFKIGGPCPDTNYLFMGDYVDRGYYSVETVSYLVAMKVRYPHRITILRGNHESRQITQVYGFYDECLRKYGSANVWKMFTDLFDYFPITALVDNKIFCLHGGLSPMIETVDQVRELNRIQEVPHEGPMCDLLWSDPDDRGGWGISPRGAGFTFGQDISEQFNHTNDLSLVARAHQLVMEGYAWSHQQNVVTIFSAPNYCYRCGNQAAIMEVDENHNRQFLQYDPSVRPGEPTVSRKTPDYFL

SEQ ID NO: 19040 - protein, 165 aa, Triticum turgidum subsp. dicoccoides
VMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAYRPPGCE

SEQ ID NO: 19041 - protein, 419 aa, Bacillus subtilis
ISSLMRHIPQANISVKSREWNRTAYVGSELYGKTLGIVGLGRIGSEIAQRRGAFGMTVHVFDPFLTEERAKKIGVNSRTFEEVLESADIITVHTPLTKETKGLLNKETIAKTKKGVRLINCARGGIIDEAALLEALENGHVAGAALDVFEVEPPVDNKLVDHPLVIATPHLGASTKEAQLNVAAQVSEEVLQFAKGLPVMSAINLPAMTKDEFAKIKPYHQIAGKIGSLVSQCMKEPVQDVAIQYEGTIAKLETSFITKALLSGFLKPRVDSTVNEVNAGGVAKERGISFSEKISSSESGYDNCISVKVTGDRSTFTVTATYIPHFGERIVEINGFNIDFYPTGHLVYIQHQDTTGVIGRVGRILGDNDINIATMQVGRKEKGGEAIMMLSFDRHLEDKIVKELTNVPDIVSVKLIDLP

SEQ ID NO: 19042 - protein, 165 aa, Triticum aestivum
VMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLIEVEEVKKEYPDAYVRVIGFDNLRQVQCVSFIAFRPPGCE

SEQ ID NO: 19043 - protein, 179 aa, Zea mays
  misc_feature (77)..(77): Xaa can be any naturally occurring amino acid
  misc_feature (178)..(178): Xaa can be any naturally occurring amino acid
  unsure (1)..(179): unsure at all Xaa locations
MARKFFVGGNWKCNGTAEEVKKIVNTLNEAQVPSQDVVEVVVSPPYVFLPLVKSTLRSDFHVAAQNCWVKKGGAFTXGEVSAEMLVNLDIPWVILGHSERRALLNETNEFVGDKVAYALAQGLSVIACVGETLEQREAGSTMDVVAAQTKAIADRVSNWSKVVIAYEPVWAIGTGKVXS

SEQ ID NO: 19044 - protein, 411 aa, Triticum aestivum
  misc_feature (324)..(324): Xaa can be any naturally occurring amino acid
  unsure (1)..(411): unsure at all Xaa locations
MAVASAWAKPGSWALAAEEQDDLPPPPPPVPASDFPDLATAATTKVPKKKKVQPVSLASFNSAKFVPSSSRGPTPDMLLSLPTGPRERTEEELGGARWGNVSRGSDEPRRGGSGTEDYGPSRADEADDWGVKKPMERRERMGGFGGDSISSRADDVNDWVSTKKTAPSLPMERRERSSAFGSESQGRADDSTSWVSNKSYSAPPPAPSDGRRGGSVWGFNRDGCPDADSWARKREEVSSGGGSSSARPRLVLQKRTLPVAVVTDGEKDEGVEEDKREFQPKSWSCNPFGAARPREEVLAAKVENLTKEVYEREEKLVIQPKVRXANPFGAARPREEVLAGKGEDWRKIDEKLEALKVREAPPEVRSPGRRGSPVQGEENENGEVLERSTGRVWKKPTAVEAEVLSEQGSDN

SEQ ID NO: 19045 - protein, 95 aa, Zea mays
  misc_feature (16)..(16): Xaa can be any naturally occurring amino acid
  unsure (1)..(95): unsure at all Xaa locations
PKKLGLKVGRTPPESXFSKLGVPHWPNWGFKKTNFLWPFPPKESFSLLQGRLKLSPQAPGEDFLEFGPGTLFFFPKGINCPWEFPRAVAKPSNFE

SEQ ID NO: 19046 - protein, 336 aa, Candida glabrata CBS 138
MGSHEGIDTDVISLPRFIIEYQKRVHNATGEFTLVLNALQFAFKFIAHAIRRAELIHLGGLFGTSNATGDEQKKLDVIGDEIFINTMESSNCVKILVSEEQEDMIVFEHNTGNYAVCCDPIDGSSNLDAGVSVGTIVSLFKLQPGSTGKVEDVLRPGTEMVAACYAMYGASTHLVLTMGDGVNGFTLDTNLGEFILTEPDMRVPMYRQIYSINEGNTYYWNDNIKSFINFLKEPQDDGKPFSARYVGSMVSDMHRTFLYGGIYAYPEDKKNPKGKLRLLYEAFPMAFLMEQAGGKAVTDRGERILDLTPTHIHDKSSIWVGSPGEIDKFLKHIGKA

SEQ ID NO: 19047 - protein, 339 aa, Candida glabrata CBS 138
MPPKKKQQQPAKKKDNVDKTFGMKNKNRSTKVQRFIKQVQAQADPAKEEMKRKKLEEKKMREAAEAERRALFGNVADQRIRAGVDPKTVVCALFKMGNCNKGAKCKFSHDLNVGRKVEKKDLYQDTRDEKEKDTMDDWDEEKLRKVILSKHGNPRTTTDKVCKYFIEAVENGKYGWFWVCPNGGDKCMYKHSLPEGFVLKTKEQRRLEREALENQPKITLEEFIETERERLDKSKLTPITMQNFAEWKKKHVIERLNAMKEENSKKKPSGREVVQKLLADNKSFDDSSVAETAGTEGTAWDLTEFTEALRKADHADDANIKDYGDGSNPTFEITKKIEA

SEQ ID NO: 19048 - protein, 570 aa, Emericella nidulans
MSPPSAKSMEEGRTPSVQYGYGDPKTLEGQIEEHTATKRGLSSRQLQLLAIGGCIGTGLFVGTSTVLTQTGPAPLLMSYIVMASIVWFVMNVLGEMTTYLPIRGVSVPYLIGRFTEPSIGFASGYNYWYSFAMLLACEVSTMALLSFLSCWNPDNVGHCLGLIIEYWNPPVSVGLWIAIVLVESEFWFAGLKILAIIGLIILGVVLFFGGGPNHERLGFRYWQDPGAFNPYLVPGDTGKFLGFWTALIKSGFSFIFSPELITTAAGEVEAPRRNIPKATKRFIYRVFTFYILGSLVIGVTVAYNDPTLEAGVESGGSGAGASPFVVAIKTLVLEGSTMSSMLPSGSLPGHPVTHGCYAGSEKLYSLAGEGQAPKIFTRTNRTGVPYVAVLATWTIGLLSFLNLSSSGQTVFYWFTNITTVGGFINWVLIGIAYLVCFPPSLHLNTPDQKQRFRKALQFHGMLDMLPFKTPLQPYGTYYVMFIISILTLTNGYAVFFPGRFTASDFLVSYIVFAIFLALYAGHKIWYRTPWLTKVSEVDIFTGKDEIDRLCENDMERQPRNWLERVWWWIF

SEQ ID NO: 19049 - protein, 341 aa, Shewanella oneidensis MR-1
MKALSKLKAEKGIWLVDAPKPEMGHNDLLIKIKKTAICGTDMHIYNWDEWSQKTIPVPMVVGHEYVGEVVDIGQEVRGFNIGDRVSGEGHITCGHCRNCRAGRTHLCRNTSGVGVNREGSFAEYLVIPAFNAFKIPDDISDDLASIFDPFGNAVHTALSFDLVGEDVLITGAGPIGIMAAAVCRHVGARHVVITDVNEYRLELARKMGATRAVNVAQENLKDVMKELGMTEGFDVGLEMSGVPSAFRAMLDTMNHGGKIAMLGIPGGEMAIDWSKVIFKGLVIKGIYGREMFETWYKMASLIQSGLDISPIITHHYKIDDFQKGFDAMGSGQSGKVILSWD

SEQ ID NO: 19050 - protein, 289 aa, Triticum aestivum
  misc_feature (125)..(125): Xaa can be any naturally occurring amino acid
  misc_feature (127)..(127): Xaa can be any naturally occurring amino acid
  misc_feature (142)..(142): Xaa can be any naturally occurring amino acid
  misc_feature (173)..(173): Xaa can be any naturally occurring amino acid
  misc_feature (252)..(252): Xaa can be any naturally occurring amino acid
  misc_feature (268)..(269): Xaa can be any naturally occurring amino acid
  unsure (1)..(289): unsure at all Xaa locations
MAAAAKLTRSFSRQLSSGAARVWRQLSLEPHTPRRGAAAATGAVAAAGPTRFGLARQSSLDPTPAPDDGAVLAMPENLDATMRLLYAACQGDAAGVEELLGEGVDVDSIDFDGRTALHIAGLRGXGXVVRLLLGWKANINAXRDRWGSTPAADAKHYGHFEVYKLLRARGAKXPKTKKTPMTVSNPKEVPQYELEPLELEFRRGEEVTRGYYVPKWYGSKVFVKILDNDTFSNGDTLEGFNPDLPLLEKGRXPQFGPFVGAGTQNVPXXFVHISPQWWWIWEKRGGAPL

SEQ ID NO: 19051 - protein, 246 aa, Saccharophagus degradans 2-40
MRRRLIVGNWKMCGDFRTNQKRLEDLSSLWFGVHQTEVSVSPAYPYLAQAAGMLENTNISLCAQDVSTRENGAFTGEVSAAMLADMGCRYVMVGHSERRHYHNEGYDLIAEKFQAVCEAKMIPILCLGETTADREADRTFDVIGRQLLKVVNACGLEGLAKGVVAYEPIWAIGTGRAATPEQAQDVHSYIREILGPEGEQIRILYGGSVKPDTAEGLFAKKDIDGALVGGASLDARDFVAICRAAE

SEQ ID NO: 19052 - protein, 229 aa, Saccharophagus degradans 2-40
MTDQKVIMIRHAQSEWNAKGLFTGWADPVLTPLGRKEAAEAASNLAKLGLKFDRIYTSVLQRATETASIIAKSLNCQVPLTKSWQLNERHYGVLQGKSKEALAKQVGAEQVWRWRRGFEDMPPPMPLASPMHARFDTKYDGVEPTSLPSVESLKHTQIRAVNYWQKEVLPSIRNNSSVLVAAHGNTLRALIMYLANMSVQEVEGFEIPTGIPIELNINKHGRCSSWRYI

SEQ ID NO: 19053 - protein, 964 aa, Leptospira interrogans serovar Lai str. 56601
MNSTLQNQTKTNLEKVGTDPLDTFPRRHIGPNLQQTAEMLKELGLSSVEELIDKAVPVGIRLKKSLDLPKASTEHKILQNLKGIASQNQVFRSYIGAGYHSCIIPGVIQRNILENPGWYTAYTPYQAEISQGRLEALLNFQTMIIDLTGLEISNASLLDEGTAAAEAMFLAYSVRKNETAKKFFVSELCHPQTIDVVVTRANPLGIEVQIGNHESIELNEDFFGVLLQYPATDGKVIDYTSFIQRSHNVGAISTVAADLLALTLLKSPGEMGADIAVGSSQRFGLPLGFGGPHAGYFATKDEFKRSMPGRLIGVSKDSQGNSGLRLSLQTREQHIRRDKATSNICTAQVLLAVISSMYAIYHGPEGLKNIATRIYKFTSIFANVLKNAGFSITNEFFFDTITIQAGAKVQEILNRAYSKKINFREYKDGKIGITLDETVNLEDLKDLLEIFEIKNTDIEKLFVDVSNVPDSFKRKTSYLTHPVFQSHHTETKMLRYIRKLESRDLSLTTSMIPLGSCTMKLNATTEMYPVTWPEFGAIHPFAPADQTKGYKIIFEQLEKWLCEITGFAGVSLQPNAGSQGEYAGLLAIRRYHESRNESYRNVCLIPISAHGTNPASAAMAGFQVVVVSCDPNGNVDLEDLKAKAEEHKKDLAALMITYPSTHGVFEESVKEICQIVHSCGGQVYMDGANMNAQVGLTSPGEIGADVCHLNLHKTFCIPHGGGGPGVGPIGVAKHLVPFLPGHVLVNNATGNEHGAVSAAPWGSASIVLISWVYIALMGSEGLTNATRNSILNANYIAKRLEKVYPVLYKGKNGFVAHECILDLRPFKKSAGIEVEDVAKRLIDYGFHAPTMSFPVPGTLMIEPTESESLEELDRFCEAMLLIYQEILDVQNGTLDKTDNPLKNSPHTAAMVTSDRWDHLYPRERAAYPASWLKDHKFWPYVGRVDNVYGDRNLVCSCLPIESYQ

SEQ ID NO: 19054 - protein, 121 aa, Triticum aestivum
MLPAPPSPAPRGRFVAARVKAEAEAMATEKLGVRVERNPAESRLSELGVRQWPKWGCEKSKFPWTYSAKETCYLLQGKVKVYPDGEEGFVEIAAGDLVVFPKGMSCTWDVAEAVDKHYKFE

SEQ ID NO: 19055 - protein, 98 aa, Glycine max
MAWRGHLSKNIKELRFLMCQSSPASSPARAFVERNYKELKTLNPKLPILIRECSGIEPQLWARYDLGVEKGIKLEGLSEAQIFKALEDLSKAGQSLKA

SEQ ID NO: 19056 - protein, 444 aa, Listeria innocua
MAKYTKEDIFRFADEQNVKFIRLQFTDILGIIKNVEIPVSQLKKALDNKIMFDGSSIEGFVRIEESDMYLFPDLDTWVVFPWTAEKGKVARMICDIYNPDMTPFAGDPRANLKRVLKEMEELGFTEFNLGPEPEFFLFKLDENRRPTLELNDSGGYFDLAPTDLGENCRRDIVLELEEMGFEIEASHHEVAPGQHEIDFKYEDAITACDSIQTFKLVVKTIARKHGLHATFMPKPLFGVNGSGMHFNMSLFTEEGNAFFDKEGELELSKTAYHFLAGMLKHARGFTAVTNPTINSFKRLVPGYEAPCYIAWSGKNRSPLVRVPSSRGLSTRLELRSVDPSANPYLAMAVLLKAGLSGIKDELTPPAPVDRNIYGMNEEEREATGIYDLPESLGHALIELEKDDIIRDGLGEHIFEHFIEAKTIECDMFRTAVHPWEREQYLEIY

SEQ ID NO: 19057 - protein, 568 aa, Triticum turgidum
MASWFETYHHPSKPPRERETAAFFGCRLGIRENNCELTCASCRSFLPPVKILIRSIRLGCCCSWVRGSCACCCSWIRGLCGRKKREAGKETSTPETKKTKRKWRRNFCGWTSHEAEEPLTSETKKKREAGQEASTSETKKTKRKWGRSFCGWTSHEAEEPLTSETKKKRKNGASSSEPDKKRWFKNKIWRKKKAKNKQLATLVKEISLPNSPKARAAAGEILRIGNHNIPSRVFAYSQLSDATNSFSQENLLGEGGFGRVYKGYISETMEVIAVKQLDKDGLQGNREFLVEVLMLSLLHHPHLVTLLGYCTECDQKILVYEYMPLGSLQDHLLDLTPKSQPLSWNTRMKIAVDAARGLEYLHEVANPPVVYRDLKASNILLDGNFSAKLADFGLAKLGPVGDKTHVTTRVMGTYGYCAPEYAMSGKLTKMSDIYCFGVVLLELITGRRAIDTTKPTREQILVHWAAPLFKDKKKFTKMADPKLDSKYPLKGLYQALAISSMCLQEEASSRPLISDVVTALTFLADPNYDPPDDIEPLPITVPDFDRGISLSEPEEVKEKFEGKQVEDS

SEQ ID NO: 19058 - protein, 165 aa, Triticum aestivum
VMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 19059 - protein, 165 aa, Secale cereale
VMASSATSVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCV

SEQ ID NO: 19060 - protein, 809 aa, Arabidopsis thaliana
MGKKRIMFFASLLLITIFLSFSYAGITRESPLSIGKTLSSSNGVYELGFFSFNNSQNQYVGIWFKGIIPRVVVWVANREKPVTDSAANLTISSNGSLLLFNENHSVVWSIGETFASNGSRAELTDNGNLVVIDNNSGRTLWESFEHFGDTMLPFSNLMYNLATGEKRVLTSWKSHTDPSPGDFTVQITPQVPSQACTMRGSKTYWRSGPWAKTRFTGIPVMDDTYTSPFSLQQDTNGSGSFTYFERNFKLSYIMITSEGSLKIFQHNGMDWELNFEAPENSCDIYGFCGPFGICVMSVPPKCKCFKGFVPKSIEEWKRGNWTDGCVRHTELHCQGNTNGKTVNGFYHVANIKPPDFYEFASFVDAEGCYQICLHNCSCLAFAYINGIGCLMWNQDLMDAVQFSAGGEILSIRLASSELGGNKRNKIIVASIVSLSLFVILAFAAFCFLRYKVKHTVSAKISKIASKEAWNNDLEPQDVSGLKFFEMNTIQTATDNFSLSNKLGQGGFGSVYKGKLQDGKEIAVKRLSSSSGQGKEEFMNEIVLISKLQHKNLVRILGCCIEGEERLLVYEFLLNKSLDTFLFDSRKRLEIDWPKRFNIIEGIARGLHYLHRDSCLRVIHRDLKVSNILLDEKMNPKISDFGLARMYQGTEYQDNTRRVAGTLGYMAPEYAWTGMFSEKSDIYSFGVILLEIITGEKISRFSYGRQGKTLLAYAWESWCESGGIDLLDKDVADSCHPLEVERCVQIGLLCVQHQPADRPNTMELLSMLTTTSDLTSPKQPTFVVHTRDEESLSQGLITVNEMTQSVILGR

SEQ ID NO: 19061 - protein, 156 aa, Gossypium barbadense
LKAEMMKNTIKECEQPAIEGEEKYCATSLESMIDYSISKLGKVDQAVSTEVEKQTPMQKYTIAAGVQKMTDDKAVVCHKQNYAYAVFYCHKSETTRAYMVPLEGADGTKAKAVAVCHTDTSAWNPKHLAFQVLKAEPGTVPVCHFLPRDHIVWVPK

SEQ ID NO: 19062 - protein, 243 aa, Staphylococcus aureus
MNQKNPKDTQNFITSKKHVKEILNHTNISKQDNVIEIGSGKGHFTKELVKMSRSVIAIEIDGGLCQVTKEAVNPSENIKVIQTDILKFSFPKHINYKIYGNIPYNISTDIVKRITFESQAKYSYLIVEKGFAKRLQNLQRALGLLLMVEMDIKMLKKVPPLYFHPKPSVDSVLIVLERHQPLISKKDYKKYRSFVYKWVNREYRVLFTKNQFRQALKHANVTNINKLSKEQFLSIFNSYKLFH

SEQ ID NO: 19063 - protein, 73 aa, Glycine max
SWKTDLLEIVEHFNIDVENPCVIMSQDKSREFLHSGNNKDKFKFFYKVTLLQQVNDLLESISHRGAFYGSGFG

SEQ ID NO: 19064 - protein, 534 aa, Porphyra purpurea
MMKKKVHPIVLAILDGWGHSNSHQGNAIKIAKTPTIDSLLETYPNTLLVASGEEVGLPKGQMGNSEVGHTTIGGGRVVEQELVKIGNSIENKSFFNNVQLNCACDHAISTQTSLHLIGLCSNGGVHSHLDHLLALIHVAESKKVPNLYIHLITDGRDTNSNSAKSFIKLIADHIEKKSFVIISTISGRYYAMDRDFRWSRTKAAYTVLTSDNSDITNQPLNYNDLIDHYYNKGISDEFIPPSRINTGSIKDGDAIIFFNFRPDRMRQLVQALVQKPFNCFLTKSLSHLHVLTFTNYDSSLNTALAFPPNTLNNFLGETISKYGLKQFRVAETEKYAHVTYFFNGGAEEPFSGEDRELVSSPSVTTYDLSPDMSAELVTQKSISAINKGIYSCIVINYANADMLGHTGKLKETIRSIETVDNCIALLFDAVSQSNGTLIITADHGNAECMLTNEGTSCTSHTTNLVPFILIEGEQATISGHGGQVEFRKNGSLADVAPTILDILNLKKPPEMTGKSLIINSKYETRNLDKTFIEL

SEQ ID NO: 19065 - protein, 466 aa, Pseudomonas fluorescens Pf-5
MDQTLKQGELKRGLKNRHIQLIALGGAIGTGLFLGSAGVLKSAGPSMILGYAIAGFIAFLIMRQLGEMIVEEPVAGSFSHFAHKYWGGYFGFLAGWNYWVLYVLVGMAELTAVGKYVQFWWPEIPTWVSAAVFFVLVNLINMMNVKFFGEAEFWFAIIKVVAIVGMIVLGCYMLFSGSGGSQASVSNLWSHGGFFPNGGTGLLMAMAFIMFSFGGLELVGITAAEAAEPRKVIPKAINQVVYRVLIFYVGALAVLLSLYPWDELLVSLNAGGDAYSSSPFVKIFSLIGSDAAAQILNFVVLTAALSVYNSGVYCNSRMLYGLAEQGDAPKALMKLNKQGVPILALGISALITLLCVLVNYLAPHEALELLFALVVAALMINWALISLTHLRFRKAMAEQGVVPSFKAFWSPLSNYLCLAFMVMIVGVMWMIPGIRASVYAIPVWVLVIWGFYLLSRAKKASQPALR

SEQ ID NO: 19066 - protein, 131 aa, Brassica napus
IGQIICRFEQKGFTLKGLKLITVDRPFAEKHYQDLSAKPFFSGLVDYIISGPVVAMIWEGKNVVLTGRKIIGATNPAASEPGTIRGDFAIDIGRNIIHGSDSVESANKECALWFPDGPVNWQSSLHSWIYE

SEQ ID NO: 19067 - protein, 375 aa, Oryza sativa
MLLPPHPGRTLPAYHGDNRFLLGACFLSKLPMLRPMKLSLVCSANPNNHRSRSSDITRHQKGGSARRKSKPYQEKDDSENIDEFDTDIMSSKNGPPISLTSNSRPQATSVPGEREKEIVELFKRVQAQLRARGKGKEEKKPEQAKAQGERGSVDSLLNLLRKHSVDQRRKSGDEKEQSVDQTKRSNESGNKQNSSIFIKNDTQEEQKKPHPAAFKRPASNFRRRSPVPNVKFQPVTNVDAERVINNINDAVQEAKPTLENKAATDEPDSVSTFEPNSVIEPENLSLDDLDHISDDEPDASDTDEPSGEYDEPSLQIPSVPIIDESHDTTLKSSLGGPDLSTLKVTELRELAKSRGIKGYSKMKKNDLVELLSNMA

SEQ ID NO: 19068 - protein, 171 aa, Brassica napus
MAASLPTTLCLSHGDESCKRSLTHGYALAVKRNLMGHSRNTVRRLVVTAATEGSRKSKESQPSWANPDSDEPPPWARNEGPSSTSQESFEVPFYVYLLASAITAIAAIGSVFEYSSKNPVFGVLDSDSIFYTPVLGFFAFTGIPTSVFLWFKSVEAANKEAAEQDKRDGYR

SEQ ID NO: 19069 - protein, 494 aa, Pseudomonas fluorescens Pf-5
MRRPGQRHKDGPSQRFIRAHNNKEALKVTTSNKGFEAISNREHGLRRQLTAGQMSMIAIGGAIGTGLFMGSAYAIGYAGPSVLLSYAIGALITLILMGCLAEMTVAHSTSGSFGAYAEFYVSPLAGFLVRYAYWAAIVLAVGAEVTAIAMYMKYWFANVPEWVWIISFSSVLIVLNGISVKTFGNFEYWFSTIKIAAIVGFIILAVYVVFGSGNPDYGLHNYSAHGGFFPNGFEGMWIAVIVSIFSYLSVEMIAVAAGEAKDPQRAVKQAFRATIVRLVVFYLLTLALMLAIVPWAQAGKAQSPFVTVMQTIGIPGATGVMNFVILIAALSAMNSQLYITTRMMFSLSRAGYAPKSMGALSKNGIPLNALLLSSSGIALATLVNVLYPESSFTLMMAISMFGAIFTWFMIFLTHYCFRRYHQRHGEQQLSFRMRLFPYSTLLGLVLMGAVMITTFFTEAFKMTLVFGVPFLLLLTLVYYLCFRKPRVVAGLSEV

SEQ ID NO: 19070 - protein, 331 aa, Photorhabdus luminescens subsp. laumondii TTO1
MTIKVGINGFGRIGRIVFRAAQERSDIEIVAINDLLDAKYMAYMLKYDSTHGRFNGTVEVKDGHLIVNGKAIRVTAERDPANLKWNEVGVDVVAEATGIFLTDETARKHIAAGAKKVVLTGPSKDDTPMFVMGVNHKAYAGQEIVSNASCTTNCLAPLAKVINDKFGIVEGLMTTVHATTATQKTVDGPSAKDWRGGRGAAQNIIPSSTGAAKAVGKVIPELNGKLTGMAFRVPTPNVSVVDLTVRLEKPATYQQICDAIKDAAEGELKGVLGYTEDDVVSNDFNGEKLTSVFDAKAGIALNDNFVKLVSWYDNETGYSNKVLDLIAHISK

SEQ ID NO: 19071 - protein, 305 aa, Rickettsia rickettsii
MKYPMLPSIAKHAALHQVNPLRKHGQNFIFDSSLCDKIVRASNLAENSRVLEIGPGTGGLTRSILQKNPESLTVIETDERCLPLLNEIKEYYPNLNIIKQDALKINLTDLSCDIVNSVGFAYKKREAKPITNRRANDIGESKLIDYKVTIISNLPYHIGTELVIRWLKEARLITSMTLMLQKEVVERICAIPSTKAYGRLSVICQLIAKVEKCFDVAPTAFYPPPKVYSAIVKLIPLENPLSIALINKVEQITKLAFAGRRKMIKSSLKNLVPNIHEVLTQLNINDNYRAENLAPQDYLRIAEIL

SEQ ID NO: 19072 - protein, 307 aa, Arabidopsis thaliana
MSLINEHCNERNYISTPNSSEDLSSPQNCGLDEGASASSSSTINSDHQNNQGFVFYPSGETIEDHNSLMDFNASSFFTFDNHRSLISPVTNGGAFPVVDGNMSYSYDGWSHHQVDSISPRVIKTPNSFETTSSFGLTSNSMSKPATNHGNGDWLYSGSTIVNIGSRHESTSPKLAGNKRPFTGENTQLSKKPSSGTNGKIKPKATTSPKDPQSLAAKNRRERISERLKVLQELVPNGTKVDLVTMLEKAIGYVKFLQVQVKVLAADEFWPAQGGKAPDISQVKEAIDAILSSSQRDSNSTRETSIAE

SEQ ID NO: 19073 - protein, 90 aa, Nostoc sp. PCC 7120
MEIKIEHQPSPEILQKLGVFQWGLWQKEVSKFPWTYDTQETCYFLEGDVIVTPDGGQPVQMGKGDLVTFPVGMSCIWEIKSGVKKHYSFD

SEQ ID NO: 19074 - protein, 1015 aa, Coccidioides immitis RS
MFTFTPLLGAQYSHSKASQSILELDGGVKILIDVGWDETFDPSALKELEKHIPTLSLILLTHATPSHIGAFVYCLYATYPVISFGRSLLQDLYSSAPLASTFLPTTSSISDSNGSGSVPTQDPTAPAGALTEGDTLNSTTAGKILLPSPTSEDIARHFSLIHPLKYSQPHQPLPSPFSPPLNGLTITAYNAGHTVGGTIWHIQHGMESIVYAVDWNQARENVIAGAAWFGSSGANRTDVIEQLRKPTALVCSAKGGDKFAPGGGRKKRDDLLLDMIRSCIARKGTVLLPTDTSARVLELAYVLEHAWREAADGPDGENSLKNANLYLAGKKVHGTMRLARSMLEWMDESIVREFEGGDGGESLGAGRSSGAASGQQSKGTPGQTSDKKSAGPHKGLGPFTFRHLKIIERKTKLENILRSEGPKVIIASDTSLDWGFSKEILRHVAQGAENLVILTESSAGPANPSSSDSTATIRDSLGHTIWQWYGERKDGVALEKASDGELLEQVHSGGRELTFIDVQKAPLDPDELVIYQQYLATQRQLQNTAQGRGETDLENAPDALDDASSSTSSEDSESEQQGKVLNFSTTLAHSNRSKLALTDADLGVNILLRRRNVYDYDVRGKKGRERMFPYVVPRRRGDQYGDFIRPEEYLRAEEREEAQMQVQRGPDGRIQPAPGQKRRWGETGNGDKLGPSKRQQPQKDQQADMSLSGSLDLNGVEDSEVSEEESAGQDVSGPTKATLVHSAVNMNARIAYVDFAGLHDKRSLEMLIPLIQPRKLILIGGMKDETIALASECRSLLAANAGLDGATSKPGVDIFTPQLGDTVDASVDTNAWMVKLSRALVRRLRWQNVRSLGVVALTANLQGPDTATQNDDVEEPSKKKAMLQKGADIQGPNVVESRANEALIKKEVFPLLDVLPPNLAAATRSLSKPLHVGDLRLADLRKLMQASGHSAEFRGDGTLLIDGFVVVRKSGAGKIEIESSARAATVNPKASKGDEGTFLAVKRKIYDCLAVVARG

SEQ ID NO: 19075 - protein, 411 aa, Thermosynechococcus elongatus BP-1
MPGGVSSPVRAFKSVGGQPIVFDHVKGAHIWDVDGNQYIDYVGSWGPAIVGHAHPEVIDALHAALEKGTSFGAPCLLENILAEMVIAAVPSVEMVRFVNSGTEACMAVLRLMRAYTQREKVIKFEGCYHGHADMFLVKAGSGVATLGLPDSPGVPKATTAATLTAPYNDLEAVSRLFEQYPNDIAGVILEPVVGNAGFIPPDAGFLEGLRELTKQYGALLVFDEVMTGFRIAYGGAQEKFGVTPDLTTLGKVIGGGLPVGAYGGRAEIMKMVAPAGPVYQAGTLSGNPLAMTAGIKTLEILSRPGSYEHLDRITGKLVQGLLDAAREFGHEVCGGHISGMFGLFFTAGPVTNYEQAKQSDLKKFAAFHRGMLEQGIYLAPSQFEAGFTSLAHTEADIERTIAAARTVLSQL

SEQ ID NO: 19076 - protein, 330 aa, Agrobacterium tumefaciens str. C58
MTKFDVLTVGNAIVDIISRCDDRFLNDNAITKGAMNLIDAERAELLYSLMGPALEASGGSAGNTAAGVANFGGKAAYFGKVAEDQLGEIFQHDIRAQGVYFETKPEGTFPPTARSMIFVTEDGERSMNTYLGACVDLGPEDVEDDVVAKTKVTYFEGYLWDPPRAKDAIRECARIAHENGREVSMTLSDSFCVGRYRDEFLDLMRSGTVDIVFANKQEALSLYETEDFELALTKIAADCKIAAVTMSEEGAVILRGTERVKVEAYPVHDVVDTTGAGDLFAAGFLFGYTQDRSLEDCGKLGCLAAAAVIQQVGPRPMSPLKALGEKHGLI

SEQ ID NO: 19077 - protein, 289 aa, Mycobacterium sp. MCS
MSDWTAADLPSFAGRSVIVTGANSGLGLVTARELARVGADVVLAVRNTAKGDEAAATMTGNVTVRKLDLQDLASVREFAAGTDRVDVLVNNAGIMAVPYARTVDGFESQIGTNHLGHFALTNLLLPKITDRVVTVSSFMHVLGRINLDDLNWKARPYSAWLAYGQSKLANLLFTSELQNRLRRAGSPVRALAAHPGYSHTNLQGQSGRKLGDALMAFGGEYFATDADFGARQTLYAVAQDLPGDTFVGPKFAMRGPTGPVWRTPLARDMKTAAALWELSEQLTGTRFPL

SEQ ID NO: 19078 - protein, 304 aa, Zea mays
MAAAPSSLVSSHLSRLADLRRAAAPATPTVPQQLRVGCSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKTPDFATIINSVTAKKVAA

SEQ ID NO: 19079 - protein, 1058 aa, Arabidopsis thaliana
MDEHGDHRQSNPFNDQQTSSGKILRIRLENFMCHSNLEIEFGDWVNFITGQNGSGKSAILTALCVAFGCRARGTQRAATLKDFIKTGCSYALVYVELKNQGEDAFKPEIYGDTLIIERRISDSTSLTVLKDHQGRKISSRKEELRELVEHYNIDVENPCVIMSQDKSREFLHSGNDKDKFKFFYKATLLQQVDDILQSIGTKLNSANALLDEMEKTIKPIEKEINELLEKIKNMEHVEEITQQVLHLKKKLAWSWVYDVDRQLKEQNEKIVKFKERVPTCQNKIDRKLGEVESLRVSLTEKKAQVACLIDESTAMKRELECLRQSMKKAAREKIALEEEYHHKCSNIQKIKDRVRRLERQIEDINEMTIRSTQVEQSEIEGKLNQLTVEVEKAESLVSSLKEEENMVMEKASAGGKEKEHIEEMIRDHEKKQRNMNAHINDLKKHQTNKVTAFGGDKVINLLRAIERHHRRFKMPPIGPIGAHVTLINGNRWASAVEQALGNLLNAFIVTDHKDLVALRDCGKEAKYNNLKIIIYDFSRPRLDIPRHMIPQTEHPTILSVLHSENTTVLNVLVDVSCVERHVLAENYEVGKIIAFERRLSHLKDVFTIDGYRMFSRGPVQTTLPPRPRRPTRLCASFDDQIKDLEIEASREQSEIQECRGQKREAEMNLEGLESTMRRLKKQRTQLEKDLTRKELEMQDLKNSVASETKASPTSSVNELHLEIMKFQKEIEEKESLLEKLQDSLKEAELKANELKASYENLYESAKGEIEALEKAEDELKEKEDELHSAETEKNHYEDIMKDKVLPEIKQAETIYKELEMKRQESNKKASIICPESEIKALGPWDGPTPLQLSAQINKINHRLKRENENYSESIDDLRIMHGEKEQKIGKKRKTYKSCREKLKVCKDAVDSRWNKLQRNKDLLKRELTWQFNHHLGKKGISGNIRVSYEDKTLSIEVKMPQDATNSAVRDTRGLSGGERSFSTLCFTLALQNMTEAPIRAMDEFDVFMDAVSRKISLDTLIDFALKQGSQWMFITPHDISMVKSHEKIKKQQMAAPRS

SEQ ID NO: 19080 - protein, 352 aa, Treponema denticola ATCC 35405
MGELISRTTSDILLDMLIEQNGSPLSGEEAALHLGLSRVSVWKAVQKLRDEGYEIEGGKNKGYILKSSSDVLNAFSIEKNLSAFAQSVCKGKVEVFKTIDSTNTEAKRRLTSSSRAESLHGTVLFAEHQSAGRGRFSRSFYSPKGAGLYFSLIFCPSIPARTEREVPSSDLYTAISATVICRCLKALGFAPQIKWVNDIYLNGKKICGILSEGIIDMETSSVQAVIIGIGLNVKESNFPPELKNKAGSLFTETGSSFSEAEVPSLNRNVLASSIMSSLIEALYGLHSQKNLMEEYKNLSLLTGKKVRVLPFAGIPYQALVLGISDLGHLIIETDDGKKEELISGEVSLELEP

SEQ ID NO: 19081 - protein, 1108 aa, Pseudomonas syringae pv. tomato str. DC3000
MAKKPDAATFIKDPLWYKDAVIYQVHVKSFFDANNDGIGDFAGLIEKLDYIAALGVNTIWLLPFYPSPRRDDGYDISEYRDVHSDYGTMADAKRFIAQAHKRGLRVISELVINHTSDQHPWFQKARNAKPGSKARDFYVWSDTDQKYDGTRIIFLDTETSNWTWDPVAGQYFWHRFYSHQPDLNFDNPHVLDAVLEVMRFWLDLGIDGLRLDAIPYLIERDGTNNENLPETHQVLKRIRAEIDANYPDRMLLAEANQWPEDTQLYFGDSKGPDGDECHMAFHFPLMPRMYMALAQEDRFPITDILRQTPEIPENCQWAIFLRNHDELTLEMVTDRERDYLWNYYAADRRARINLGIRRRLAPLVERDRRRVELLNSMLLSMPGTPTLYYGDEIGMGDNIYLGDRDGVRTPMQWSIDRNGGFSRADPASLVLPPIMDPMYGFQSVNVESQERDPHSLLNWNRRMLAVRKQQKAFGRGTLKMLSPSNRRILAYTREYTAPDGHSEVVLCVANVSSAAQAAELDLSGYAGTVPVEMLGGSAFPPIGQLNYLLTLPPYGFYWFLLATENQMPSWHVEPAQSMPDFPTLVLKKRLEELLEEPLRSTMEDTSLTVYLPKRRWFAGKDKAIEKVNIAYAVRFGDEAHPVLLSEIEVTAGGQTDRYQLPFGLLGEDDISSALPQQLALARVRRSRDVGLITDAFTLETFIRAVIQGMQSDTVIPCADGQLRFEQSSQLAPLGLTHESEVRYLSAEQSNSSVVVGSSLVLKLIRKVSAGTHPELEMGAFLTHAGFKNISPLLGSLVRVGNDGQPNLLMIAQGYLSNQGDAWEWTQNNLERAVRDELAHGVSGQEQHYNALLELADFSRSLGQRLGEMHQILASPTDNADFAVEITSAQDSKASATSVNAQLERALQLLEQRKGDLDKDDQQLVSDLLAHRKQIRQRVEGLAKRSAGGLRIRVHGDLHLGQVLVVKGDAYLIDFEGEPARALEERRAKHSPFKDVSGVLRSFDYAAAMAVRSAQSVDTSPQAAAARKQVAETYLAQAREAFIEGYRLATSGIAHAWKDAKGEDSALELFTLEKAAYEVIYEAENRPAWLAVPLQGLRGLLQPSDGEPI

SEQ ID NO: 19082 - protein, 372 aa, Candida glabrata
MSESELRQRQAEFTKELHGEGAESRTGLTALLSKNRNAQREAVSKYLRHWDGKTDKEAEDRRLEDYNEATHSYYNVVTDFYEYGWGSSFHFSRFYKGENFQAAMARHEQYLAYMAGIKKGDLVLDVGCGVGGPARTIARFTGCNIIGLNNNDYQIQKAKYYAKKYNLQDHMDFVKGDFMNMEFEPNSFDKVYAIEATFHAPKLEGVYGEIYKVLKPGGTFAVYEWVMTENYDENNEEHRKIAYEIELGDGIPKMFTVDVAKQALKNVGFEVEVSKDLADEDDEIPWYYPLTGEWKYVQSLSDIATFFRTSYFGRKFTNCMVSIMEKVGVAPQGSVEVTAALENAAVGLVEGGRKKLFTPMFLFVAKKPEDAK

SEQ ID NO: 19083 - protein, 529 aa, Rhodopseudomonas palustris CGA009
MTAPKVLISDALSEAAVQIFKDRGIDVDFQPNLGKDKDKLAEIIGNYDGLAIRSATKATAKILEKANRLKVIGRAGIGVDNVEIPAATAKGIIVMNTPFGNSITTAEHAITMMLSLAREIPAADASTQAGKWEKNRFMGVEITAKTLGVIGCGNIGSIVADRALGLKMKVIAFDPFLSPERAKDLGVEKVELEDIFKRADFITLHTPLTDKTKNIIDAAAIAKMKKGVRIINCARGGLVDENALAEALKSGHVAGAAFDVFSEEPATKNVLFGLPNVICTPHLGASTTEAQENVALQVAEQMSDYLLTGAITNAINFPSITAEEAPKLKPFIELAEKLGSFAGQLTETGITKVTITYEGEVAEMKIKALTSAVLSGLLRPMLGDINVVSAPVIAKERGMVVDEVVRAAESDYESLITLTVTTEKQERSVSGTVYADGKPRLVDIKGIRVDAEFGSSMIYVTNEDKPGFIGKFASLLGDAKVNIATFNLGRHTEGGDAIALVTIDGPAPTEVLEKVQALPQVKQVKALTF

SEQ ID NO: 19084 - protein, 313 aa, Haloarcula marismortui ATCC 43049
MTGWTIEDMPPLRDRTVVVTGANSGLGLEGSKAFARRGATVVMACRSVERGESAAAEIREAVPNATLDVRECDLADLSNVASFADGLRADYDAVDILCNNAGVMAIPRSETADGFETQFGVNHLGHFALTGHLLDLLGAADGESRIVTQSSGAHEMGEIDFDDLQRERSYGKWSAYGQSKLANLLFAYELQRRLGNHGWDDVLSVACHPGYADTDLQFRGPREMGSTLRTAAMGVANAVFAQSAEQGALPMLYAATAEDVIGGEYVGPGGLFDMRGSPEFQQSNDASQDEETAEQLWAVSTDLTGVEYDFERT

SEQ ID NO: 19085 - protein, 217 aa, Wolbachia endosymbiont strain TRS of Brugia malayi
MVQATYASISLPGISSVEDVLEDARFGKLFILVDDENRENEGDLIVLAEKLKPEHVAFMVRYGTGIVFLAMTRLHMGRLGLEFMRRSNIDEKLTPHTAFTTSIDARYGIATGVSAHDRTHTILTAIDGKSTQDDIITPGHVFPIIANDGGVLARNGHTEASVEIAKLIGYNHAAVGCELVNDDGSMMRLPELLKFAEQHNIKLTTIDKLIRYIKKLS

SEQ ID NO: 19086 - protein, 323 aa, Lactobacillus plantarum WCFS1
MTTKEQVLTILLRHHGEWQSGDQLAQSVGCSRESIWKAINALRKQGHQIESRKNRGYCYLGSRNLDAKAIQIYGQRQFTGPLEVVAQTPSTQILAKSFLSHHQPQFAAFFADEQTAGYGRLGRDFYSPAKTGLYFSLVVPNPTNALVNVGLLTTGVAVSVLNVLQQFYPNKNFGLKWVNDIYLDQHKVGGIITEASLELESISATAFIVGVGLNLTTTDFPRELQARAQAVDPSMSVDRNRLAAALLSALVALSKRYATADFLPAYRAKSLVLGQQVTLQVGDSVVNGVAEDIDEHGGLVVRMLTGERRTFTSGEVIRVGLPV

SEQ ID NO: 19087 - protein, 148 aa, Bacillus cereus G9241
MEKTFLMVKPDGVQRAFIGEIVARFEKKGFQLVGAKLMQVTPEIAGQHYAEHTEKPFFGELVDFITSGPVFAMVWQGEGVVDTARNMMGKTRPHEAAPGTIRGDFGVTVAKNIIHGSDSLESAEREIAIFFKEEELVDYSKLMNEWIY

SEQ ID NO: 19088 - protein, 290 aa, Bradyrhizobium japonicum
MGPGLRRDDTEFVVTTVANSTLQNITGTILLAGAGKMGGAMLTGWLAGGLDPRRVAVVDPHIAPEISALAAKGVALNPDAKAAGQVETMVVAVKPQMFREAGAKLKPFVSEKTSVVSIMAGTTIASLQEVCGGAVVRAMPNTPAAIGRGITVAVAAKNVSTAQRAVADALLRATGSVEWVEDESLMDAVTAVSGSGPAYVFLLAEELARAGVEAGLPEALATKLARETVAGSGELLHQSELPSGTLRQNVTSPGGTTAAALGVLMGEPGLRDLMIRAIAAATQRSKELAK

SEQ ID NO: 19089 - protein, 846 aa, Oryza sativa (japonica cultivar-group)
MASSSPLCCYLLLFVVVVVLTGSCRARDTVVPGRPLAANETLVSGGDANFVLGFFTPPGANSTYVGVWYNKVSVRTVVWVANREDPLPGDVADNPDATLSVSPTGTLAIVAGNSTVVWSVTPAAKLASPTARIMDSGNLVIADGAGGGVAWQGFDYPTDTLLPEMRLGVDYVKGRNRTLTAWKSPSDPSPGPVVMAMDTSGDPQVFIWNGAEKVWRSGPWDGVQFTGVPDTVTYSGFTFSFINNAKEVTYSFQVHNVSIISRLGLNSTGSYGLLQRSTWVEAAGTWNLYWYAPKDQCDEVSPCGANGVCDTNNLPVCSCLRGFTPKSPEAWALRDGRAGCVRSTPLDCQNGTDGFVAVEHAKVPDTERSVVDLGLSLEQCRKACLMNCSCTAYASANVSGGGRGHGAGTGCVMWTTGLTDLRVYPEFGQDLFVRLAAADLGLTSKSNKARVIIAIVVSISSVTFLSVLAGFLVWTRKKKRARKTGSSKWSGGSRSTGRRYEGSSHHDDDLELPIFDLGTIAAATDGFSINNKLGEGGFGPVYKGKLEDGQEIAVKTLSKTSVQGLDEFKNEVMLIAKLQHRNLVRLLGFSISGQERILVYEYMANKSLDYFLFEKSNSVLLDWQARYRIIEGITRGLLYLHQDSRYRIIHRDLKASNVLLDKEMTPKISDFGMARMFGSEETEINTRKVVGTYGYMSPEYAMDGVFSVKSDVFSFGVLLLEIISGRRNRGVYSYSNHLNLLGHAWSLWNEGKSLELADETMNGSFDSDEVLKCIRVGLLCVQENPDDRPLMSQVLLMLATTDATTLPTPKQPGFAARRILMETDTSSSKPDCSIFDSATVTILEGR

SEQ ID NO: 19090 - protein, 238 aa, Rickettsia rickettsii
MQLIVVKYMGVDSLHNLSYKEEFEGDMKRSTTAYKKVSEDASIGSTYIADTSEVGSQISGEPVQRIKIPEHRQILQFNVPNLEVSKVYKLPLEGGYARSLIKPVIMAGGNGKRLWPLSSKDKPKQFKKILSDLTLLQQTLNRNKFLGQPTIITFKKYESITKEQAAEIDVEIALITEPLQKNTAVCAIITTLSATALGFDIVVLLPSNHHIADDINYLNTINKALHYVNECGICTIFL

SEQ ID NO: 19091 - protein, 520 aa, Medicago truncatula
MKPFTSFSSKPIVHKLGSLSPSISFHVSDRPFSCFTLHSRNEQKSSIFCLLKLVQNKGVCPLHVVPSEHQEVDLEPVESQVQQSEQTNDSKFVRVEFQLLKDCDFGEQFLIVGDDPKLGLWNPLDALPLTWSDGHIWTVELDMPAGKSILYKFILKGKEGDIIWQPGLDRVIQTWETMNRIIVLEDWENAELQKIIEEDTLSQTNEEPPVLPEVSTSTDIVSGIEETQIDTLEKLIDEPVLQQIIDDHDSNSSSIENPMSMFAENIGSSEDLTESKSQTTYKANVVQKSEESADGFQNDDIKHELGYNGNPAALKNKKGTIVEGSLIDFEGGPVLVPGLIPLTEEAGPSEVVEEEKTAVEPSIESFETQDQNIPELSKEQVSNDETAQEISSTSNDETAQEISSTINDELNFHEEQFYLASTMEEGSNSEPIHGNALQNDIQWGFETLSKDQESDDDTPQEIITNTTINDELNSHEEQFHLASTMEEESNSEPTHGNALRNDIEWGRETVKKFLTKFGLL

SEQ ID NO: 19092 - protein, 90 aa, Glycine max
MSSATSKAWIVAASVGAVEALKDQLGVCRWNYVLRCAQQHMKNHFRSLSQAKNVSSSSALVASKLKGDEKAKKAEESLRTVMYLSCWGPN

SEQ ID NO: 19093 - protein, 349 aa, Thermosynechococcus elongatus BP-1
MSNKGSSDLRLLLSTLVISGLVAGLAYWQLSQHWTRSPDQNAGSPLHTPTSKWQKIALAMTLRGHEDEVNAIALSPDGNFLVSAGDDRRLYFWNLATGTALGQAKGHTDWIYALVMTPDGQTVISGSKDKTIKLWGVGDRQLQATLSGHQDFVNGLALSPDGRTLASASYDHTVKLWNVPSRQEITTLKANEGIMLSVAISRDGRFLATGGVDKLIRIWDLPSRRLLRTLEGHTSDVNSLAFTPDSSQLVSGSDKDGIKLWNLTTGELQQQFGTEGGQVFSVAVSPDGSTLASGHGDQTVKLWSLSGQLLRNLKGHSGAVYSVVFGQDQLISASEDKTIKVWRLFPETP

SEQ ID NO: 19094 - protein, 1009 aa, Xanthomonas oryzae pv. oryzae KACC10331
MGRTRASCQLRCGSTIRLPLPRMPAMSQTPSSLRDLEHHSAFVERHIGPNDAEIAQMLEVVGHASLDALTDAIVPGNIKSPAPLALPEALTEEEALVKIRAIADKNTVYRNFIGQGYYGTHTPKVILRNILENPAWYTAYTPYQAEISQGRMEALINFQTLCADLTGMQIANASLLDEATAAAEAMTLAKRSAKSRSDIFFVHDAVHPQTLELLRTRAEPLDIMLRVGTPEEALQAECFGVLLQYPDSFGHIGDHAALAEAVHAQGGLVAVATDLLALTLIAAPGQWGADIVVGNSQRFGVPFGFGGPHAAFMACRDAYKRSMPGRLIGVSIDAAGNPAYRLTLQTREQHIRREKATSNICTAQVLLAVMASMYAVYHGPDGLTRIARRTHRLAAILAAALRGAGVTVGEHFFDTLHVKAIDADAIHARARAAGINLRAIDSEAVGISLDETTTRADVVALAQLFGAMADVDALDAATADALPQGLLRSSAFLTHPVFNTHHSEHELLRYMRSLADKDLAMDRTMIPLGSCTMKLNATAEMIPVTWPEFGAIHPLAPAEQSAGYAQLIDELEAMLVECTGYDAVSLQPNSGAQGEYAGLLAIRAYHRSRGEAHRDICLIPESAHGTNPASAQMCGMTVVVTKCDANGNVDVDDIRAKAEKYSDRLAALMITYPSTHGVFEEDVVAICEAVHAHGGQVYTDGANMNALVGVAKPGKWGSDVSHLNLHKTFCIPHGGGGPGVGPCAVKSHLAPFLPRAGLHAGEGQTAAIHGGGFNSGSGSGHSSRIGGMVSAAAYGSASILPISWMYVTMMGSAGLRKATQVALLNANYIAKRLAPHYKTLYTGRNGLVAHECILDVRPLEKTSGIGAEDIAKRLIDFGFHAPTLSFPVAGTLMVEPTESESQHELDRFIDAMIQIREEIRAIEDGRLDREDNPLKHAPHTATQVSASEWTHAYPRELAAFPLPSLKQQKYWPPVARVDNVYGDKNVMCACIPVDAYKIPVDAYKEDAEA

SEQ ID NO: 19095 - protein, 294 aa, Mycobacterium sp. MCS
MTIRLLGRTEIRRLAKDIDFRPRKSFGQNFVHDANTVRRIVSASGVHRHDHVLKVGPGLGSLTLALLDRGAHVTAVEIDPLLAQQLPTTIADHSHSEINRLTVLNQDILTLMPSDLENQPTALVANLPYNVAVPALLHLLAEFPTIRSVMVMVQAEVAERLAADPGGKDYGVPSAKVRFYGNVRRYGMVSPTVFWPIPRVYSGLVRIDRYETSPWPTDADFRAQVFDLIDIAFAQRRKTSRNAFAEWAGSGNESARRLLAASIDPSRRGETLAIADFVRLLQRSGEAEEQVRVQ

SEQ ID NO: 19096 - protein, 256 aa, Streptococcus pyogenes M49 591
MKIGIIGVGKMASAIIKGLKQTPHELIISGSSLERSKEIAEQLTLPYAMSHQDLIDQVDLVILGIKPQLFETVLKPLHFKQPIISMAAGISLQRLATFVGQDLPLLRIMPNMNAQILQSSTALTGNTLVSQELQARVRDLTDSFGSTFDISEKDFDTFTALAGSSPAYIYLFIEALAKAGVKNGMPKAKALEIVTQTVLASASNLKTSSQSPHDFIDAICSPGGTTIAGLMELERLGLTTTVSSAIDKTIDKAKSL

SEQ ID NO: 19097 - protein, 338 aa, Hypocrea koningii
MAPIKVGINGFGRIGRIVFRNAVEHPDIEVVAVNDPFIETTYAAYMLKYDSSHGLFKGEVEVDGKDLVVNGKKVRFYTERNPADIKWSETGAEYVVESTGVFTTTEKAKAHLVGGAKKVIISAPSADAPMYVMGVNESDYDGSADVISNASCTTNCLAPLAKVINDNYGIVEGLMTTVHSYTATQKTVDGPSAKDWRGGRGAAQNIIPSSTGAAKAVGKVIPALNGKLTGMSIRVPTANVSVVDLTVRIEKGASYEEITETIKKAADGPLKGVLAYTGDDVVSSDMLGNTNSSIFDIKAGISLNKNFVKLVSWYDNEWGYSRRVLDLLAHVAKVDASK

SEQ ID NO: 19098 - protein, 336 aa, Hypocrea koningii
MVPKVGINGFGRIGRVVLRNALETGAVEVVALNDPFIEPHYAEYMFKYDSTHGRFKGDIKVDGKDLVIDGKRIKFYQERDPANIPWKDSGAEYIVESTGVFTTTEKASAHFKGGAKKVIISAPSADAPMYVMGVNEDTYAGANVISNASCTTNCLAPLAKTLNDKFTIVEGLMTAIHAYTASQKTVDGPSSKDWRGGRAAAQNLIPSSTGAAKAVGKVIPELAGKVTGMSVRVPTVNVSLVDFTVRFAKDVTYDEVKAAIKEASEGPLKGILAYTEDDIVSTDILTDPHSSTFDAKAGIALNKNFVKVMSWYDNEYGYSRRVVDLIVYVSKKDAGQ

SEQ ID NO: 19099 - protein, 202 aa, Arabidopsis thaliana
  misc_feature (18)..(18): Xaa can be any naturally occurring amino acid
  misc_feature (31)..(31): Xaa can be any naturally occurring amino acid
  misc_feature (40)..(40): Xaa can be any naturally occurring amino acid
  misc_feature (108)..(108): Xaa can be any naturally occurring amino acid
  misc_feature (118)..(118): Xaa can be any naturally occurring amino acid
  misc_feature (144)..(144): Xaa can be any naturally occurring amino acid
  misc_feature (176)..(176): Xaa can be any naturally occurring amino acid
  misc_feature (180)..(180): Xaa can be any naturally occurring amino acid
  misc_feature (185)..(185): Xaa can be any naturally occurring amino acid
  misc_feature (188)..(188): Xaa can be any naturally occurring amino acid
  misc_feature (193)..(193): Xaa can be any naturally occurring amino acid
  unsure (1)..(202): unsure at all Xaa locations
VPLSGKTCWVKKGGAFTXGEVSPEMLVNLDXPWVILGHSXERRAILNESSEFVGDKVAYALAQGLKVIACVGETLEEREAGSTMDVVAAQTKAIADRVTNWSNVVISXMKPVWAIGTXGKVASPAQAQEVHDELRKWLAKNVSXDVAATTRIIYGGSVNGGNCKELGGQADVDGFXGGGXSLKPXFIXIIKAXEVRKPISLI

SEQ ID NO: 19100 - protein, 138 aa, Triticum aestivum
VAPFQGLKSTAGLPVSRRSNGASLGSVSNGGRIRCMQVWPIEGIKKFETLSYLPPLSTEALLKQVDYLIRSKWVPCLEFSKVGFIFREHNASPVEVEEVKKEYPDAYVRIIGFDNMRQVQCVSFIAFKPPGCEESGKA

SEQ ID NO: 19101 - protein, 370 aa, Methanothermobacter thermautotrophicus
MILPLGPMHPGYKEPIRLKVKTRGEKVLKAEIEYGYVHRGIERVMRNKTWQKAIYLSERVCGICSYIHTQTFAEAFEAISEVEAPPRAQFLRALTNELDRIQSHLIANSTYFKALDHETMFMYMLALREPVMDAIELLTGNRVNMGWNVVGGVRMDASEDHLSRIREIIVDLEREFDRYVEMFEHGPLIGLRSRDVGYMSREEAEKARAVGPIGRASGIRYDFREDHPTYRDHLDFRTIWRDEGDNFARVMNRFDEIRVSIDLIKQVIDSIPSGPVRRKVDVKAGYGEWRNEAPRGEVAYMIETNGNLIKNISIRTPSIMNIDACAKYMLRDVATVADAVATYASADPCIACAERVVVLDENEGKREILL

SEQ ID NO: 19102 - protein, 335 aa, Chlamydophila abortus S26/3
MKVVINGFGRIGRLVLRQFLKRNSSIEVVAVNDLVPGEALTYLFKYDSTHGRFPAEVSHENGCLVVDGRRIQLLAQSDVQKLPWKDLGVDIVIESTGLFTKKEDAEKHLASGAKRVLITAPAKGDVPTFVMGVNEHKFDPEKDLIISNASCTTNCLAPLAKVLLDSFGIEEGLMTTVHAATATQSVVDGPSKKDWRGGRGAFQNIIPASTGAAKAVALCLPELKNKLTGMAFRVPVADVSVVDLTVRLQKSTSYEEICKVVKEASEAHLSGILGYTDQEVVSSDFIGCEYSSIFDAGAGIALTDRFFKLVAWYDNEIGYATRIVDLLEYVAKNSK

SEQ ID NO: 19103 - protein, 78 aa, Arabidopsis thaliana
CYPFSDKTPFLFKTGPHVYFVGNQNKYGTRLIKGSKGQLVRLFCIPKFCETGIGVAVNLKNLEGPPLSFSPQIIQSSH

SEQ ID NO: 19104 - protein, 762 aa, Oryza sativa
MGIIVGYNTKGGLEESKDGDNGMQQDRGRGKEHVRIEVARALGWRCCRSPTDFRRAFRMPCAVFDKLCDHLATVVTKEPSSRRQIEQGSLVEFKAEAKRRGCAEMWRPSESSIARSIGECEHGAASSSWRAALPMPEKEVAQRLVRRAAAGRRRRRHPDVARRPCQGPLSFLLPCLLLCSALGPLKLPMAVPPSRASVCMSKKRREGGGGGNGGCDPPAVTDALSMDGGLREVSLSVVFSVWCLLFLLRSQFLHSQTDPSDFYDDVEDGMRENYCKVMPLEAYIFPTEYNASAAAPTCQPSLHPPDQPQQETDHRSLEPFNNTTGGKSSAEAAALDELDEFRSRILQGKAENGRVPDGATPAAHRLEPSGAEYNYAAASKGAKVLAHNREAKGAANILGGDKDRYLRNPCSADDKFVDVELSEETLVRTIGLANLEHYSSNFRDFELYGSPSYPAPAEEWELLGRFTADNAKHAQRFVLPDPRWTRYLRLRLATHYGSGFYCILSYLEVYGIDAVEQMLQEIISGSGADTDASAAAKAEEGGDGGTLRNDTAQVNARLDGVGGGGGSAAGRNDSAGDGAGAKNNGSRMTVAGDGKPAAAGRFHGDAVLKIMMQKMRSLELGLSTLEDYTKALNHRYGAKLPDLHTGLSQTTMALDRMKADVRDLVEWKGNVAKDLGELKEWRSNVEEMRSIQETMQNKELAVLSISLFFACLALFKLACDRVLFLFTRKGAAAAERMCGASKGWILVLASSSFTTFLVLLYN

SEQ ID NO: 19105 - protein, 140 aa, Rickettsia akari str. Hartford
MTIQYTFSMIKPDAIKRNKIGQVNAYLENGGLKIVAQKMRFLTKYEAECFYDEHRARTFFNSLVEYITSGAVVLQVLKGEDAIILNRTIMGATNPAEAEAGTIRKDLGESIEANSIHGSDSENSAKREIAFFFNKSEIIE

SEQ ID NO: 19106 - protein, 255 aa, Zea mays
MGDFNVALVIVAAVVSVLVLLVSVYLLVNYQHPDDVNQAYFPKLVVVLGLTVAVLSILMLPADVANRQACRKAVYNGACSLTLPMRTLWLVVYIVDAVLVFLVIPFAMFYYEGDQDKSVGKRLRTALIWVVASAVVCGLVLGILYGLVGKVDFTVRHLSSSVQTFPNSFSGFSSGQPCFSPLTRQCAASTAPANSQTPWTMRATFPEYVVALTTIVGSVLFTIFGGVGIACLPLGLIFSFVRRPKAVITRSQYIK

SEQ ID NO: 19107 - protein, 253 aa, Streptomyces coelicolor A3(2)
MADAPYKLILLRHGESEWNEKNLFTGWVDVNLTPKGEKEATRGGELLKDAGLLPDVVHTSVQKRAIRTAQLALEAADRHWIPVHRHWRLNERHYGALQGKDKAQTLAEFGEEQFMLWRRSYDTPPPALDRDAEYSQFSDPRYAMLPPELRPQTECLKDVVGRMLPYWFDAIVPDLLTGRTVLVAAHGNSLRALVKHLDGISDADIAGLNIPTGIPLSYELNAEFKPLNPGGTYLDPDAAAAAIEAVKNQGKKK

SEQ ID NO: 19108 - protein, 511 aa, Gossypium hirsutum
MMAVLFVYLGFMVFGIIVLRFLYRFIDNNGLPRNWPFVGMIPTLLLNIHRPHDKVAQVLRRSNGTFFYRGLWFTNTSFLATSDPENVRYILSSNSSVYLKGPEWLKQFDIFGEALFNSDGEAWKCHRRVFHAFLNHPQYRQSLSKVLHQRIEEALVKVLEYVSGREMVVNLQDLLAGHAFDIGCITGVGFDPGLLSIEFPENRFQKAMSDTLEAAFYRYVVPDSLWKLQSWPQIGKGKKRSDAWKALDDLLTQFISTQRHKSTKSVASSGSNEEHDFNFLNCYLTGHEITGPTPKESLIRDNLIHFLFASDGTYSLTLTWFFYLISKAPVVENKIREEIKRHLSMKQVEGSLQIPSNYDELSKLTYLHAALCETLRLYPPIPFDFRTCTKQEYLPSGHRVDQNTRIIIGIHAMGRMESLWGEDCYAFKPERWIGEDGKIKRESPTKFSAFLAGPRICPGKEVSFLLMKATATAIIHNYNVHVVEGQNIGPKNSVVYQMKKGLMVRIKKRWS

SEQ ID NO: 19109 - protein, 507 aa, Oryza sativa (japonica cultivar-group)
MEEQQEGAAGVMRRRPKTKIVCTLGPASRSVEMIGRLLRAGMCVARFNFSHGSHEYHQETLDNLRAAMESTGILCAVMLDTKGPEIRTGFLKDGKPVQLKKGQEITVSTDYSIKGDDNMISMSYKKLAVDLKPGSVILCADGTITLTVLHCDKEQGLVRCRCENTAMLGERKNVNLPGVIVDLPTLTEKDKEDILKWGVPNKIDMIALSFVRKGSDLVEVRKVLGKHAKSIMLMSKVENQEGVANFDDILAQSDAFMVARGDLGMEIPIEKIFYAQKVMIFKCNIQGKPVVTATQMLESMIKSPRPTRAEATDVANAVLDGTDCVMLSGETAAGAYPELAVRTMAKICLQAESCVDHAAVFKSITASAPIPMSPLESLASSAVRTANSAKAALILVLTRGGTTARLVAKYRPSMPILSVVVPELKQTDSFDWTCSDEAPARHSLIVRGVIPMLSAATAKAFDNEATEEALGFAISNAKAMGLCNSGESVVALHRIGTASVIKLLTAN

SEQ ID NO: 19110 - protein, 461 aa, Photobacterium sp. SKA34
MKHPNVLQITLVVALGGLLFGYDTAVISGATESLQTFFNLNPAELGFAAASALIGCVIGAIAAGYTSTKYGRRGALLIAALLFFISALGSAIPDQYWTFIFYRIIGGIGVGIASMVSPMYIAEIAPPQKRGALVSCNQFAIIFGMLVVYFVNYGIALMGSESWLNEMGWRYMFGSEMIPAGLFFCLLFSVPETPRWLAMRGRDEQAKELLSKISKGKDFDNQWKEIKDSLVEVGTASVTSRKILPILVIGIMLSVLQQVTGINVFLYYAPVILKSFSSSSTDLALLQTILVGAVNLTFTVIAIITVDKYGRKPLMMLGSGLMAVSMIAIGTAAYLNAIGGYLLFFVLTYIAAFALSLGPVTWVLLSEIFPNNVRSKALSIAVFAQWVANYAVSQTFPMMNDQNSWLFKEFNGGFPFWFYGVMGLVTIYFVHRFVPETKGKSLEELEELWEKPDELETVTHN

SEQ ID NO: 19111 - protein, 411 aa, Rhodopseudomonas palustris CGA009
MPTHDGCKEKTMPFLATALDRVKPSATIAVTDKARELKAAGRNVIGLGSGEPDFDTPANIKLAAIHAVEAGKTKYTAVDGIPELKQAIIDKFKRENGLTYKPNQIIVGTGGKQVLYNALMATINPGDEVIIPAPYWVSYPEMVALAGGESVPVVCTAEFGFKLQPAALEAAITPKTKWIILNSPSNPTGAAYSRAELKALTDVLVKHPHVWVMTDDMYEHLVYDDFEFTTPAQIEPKLFDRTLTVNGVSKSYCMTGWRIGYAGGPAELIKAMSTIQSQSTSNPCSIAQWAAVEALNGPQDFIDAHNKVFKERRDLVVSMLNQATGIDCPRPEGAFYVYPSCAGTIGKTAPSGKKIETDQDFVTELLEAEGVAVVQGSAFGLGPAFRISYATKTSDLEDACKRIQRFCGNLR

SEQ ID NO: 19112 - protein, 168 aa, Triticum aestivum
MAPTVMASSATSVDPFQGLKSTAGLPVSRRSNGASLGSVSNGGRIRCMQVWPIEGIKKCETLSYLPPLSTEALLKQVDYLIRSKWVPCLEFSKVGFIFREHNASPGYYDGRYWTMWKLPMFGCTDATQVINEVEEVNKEYPDAYVRIIGFDNMRQVQCVSFIAFKPPG

SEQ ID NO: 19113 - protein, 141 aa, Chlamydophila abortus S26/3
MEQTLSIIKPDSVGKAHIGEIIAIFEKSGFRIAAMKMLHLSVKEAEGFYAVHKSRPFFQELVDFMISGPVVVMVLEGNNAVARNREIMGATNPQEAAPGTIRAQFGESIGINAVHGSDSLENAAIEINYFFSKVEIVNSAA

SEQ ID NO: 19114 - protein, 222 aa, Saccharomyces cerevisiae
MTELDYQGTAEAASTSYSRNQTDLKPFPSAGSASSSIKTTEPVKDHRRRRSSSIISHVEPETFEDENDQQLLPNMNATWVDQRGAWIIHVVIIILLKLFYNLFPGVTTEWSWTLTNMTYVIGSYVMFHLIKGTPFDFNGGAYDNLTMWEQIDDETLYTPSRKFLISVPITLFLVSTHYAHYDLKLFSWNCFLTTFGAVVPKLPVTHRLRISIPGITGRAQIS

SEQ ID NO: 19115 - protein, 251 aa, Robiginitalea biformata HTCC2501
MAKSKILKKRNIMILDSAEDKVEQLNKMAHFDAFEKLEDCVPQADMIFVAVKPHHSKSLFEDMAGLTTKGQIIISIMAGVSIDFIRKATGLKKIVRAMPNLPAQVGKGLTSYIASDEVSRIESLTIEDLLNTTGKSILVSKEKYIDASTGISGSGPAYVFYFMQSMMEAALQMGFSANDSKVLVSQTFEGAIELFNQSDLTPDGWMKKVASKGGTTQAALDSMEDNKLNELIKEAAFAAFNRAVELGEAHV

SEQ ID NO: 19116 - protein, 156 aa, Zea mays
MHAYVSSEFGSSSSRALLVLVVSNIVDVGDVAHAALSTASVIVYFCFFVMGFGPVPNILCAEIFPTTVRGVCIAICALAFWVGDIIVTYTLPVMLNVVGLAGVFGVYAVVCVLALAFVFIKVPETKGMPLEVITEFFSVGAKQAKEEEEEEEAREG

SEQ ID NO: 19117 - protein, 247 aa, Ehrlichia canis str. Jake
MKSNINLPNGYSLEHHKILYSTNYEAIKLAECGAKDGTIIISDEQIKGRGRYERIWHSPKGNLYFSIIITKFVEIFPIPFIAALSVGKTLEEILENKEISKVQYKWPNDVLINSKKISGILLESKTLNNAPQKWIVVGIGINMYKAPEYATTIKQHNINFTLSNLELLEKVINHFNNLRKYYINYGFTKIKDLWLKQTCHLNSKITVKSHNNTYTGKFVTIDMKGNMIMQQEDKTTCITSGEIFNIT

SEQ ID NO: 19118 - protein, 357 aa, Triticum aestivum
MFSNSAMSLASPSLLSSPLPSRGALVFKKPSASSLAVSTAKRGVRVVAEAAAVSSPASSVSAQRTQPSAAEVARTVVELAPSGTLSVVGADGWPLGVGARFVADAAGAPALCLATAGVTVPDARASFHVEFRQSGARTPQCTFLGALTKPSDKYMLKKLSTRWETKFGEEIDEDRLYLISVERILHMEDFNEGRVWVVPSEYSDAEPDPLRNFAERVVEEMNSEHAEDVHRIYNIYAESDFQALDVKMIWVDRLGFDLHVHSEERHLPLVGYLSQGRALSTRRRARHSHDGHHAWEVDKSNAPQSGEGQFLRRSIDGGNLFRNDTPGRNFWDSFRTGLFFFLRQGQLGFRLNEGGIW

SEQ ID NO: 19119 - protein, 554 aa, Candida albicans SC5314
MGSSTNNTQSKATPSVLENEVNSSKSSVVSSTSSAKGLLRETTNHGTMETSSVQISESESRPSKMVLVLTLASSISGFMFGYDTGYISSALVQIGTDLSNKILTSGEKEFITSATSLGALLGAVVGGVLANLIGRRRVLLGSNIIFVVGTIIQLAARTVWTMIAGRFVLGWGVGIASLIAPLMISELAPAKYRGRLIVTNVIFITGGQLIAYFINWGLTRVSHGWRVSVGLCMVPPVLQFVLFWFLPDTPRFYVMNGNFEKARQVLRKVHVDPSDEFVNATIDEMIASDSTVPGNGPLQKAWKSIKIIHTTPGNFRALILACGLQGIQQFTGFNSLMYFSATIFETIGFHNATAVSIIIAATNFVFTGIAICIIDKVGRRRILLVGMPCMCISLIVCAVAFHYLNVDFSTGTVVSRGINGWGIVVIIGMILYVASYAIGIGNAAWVGVEMFSDVNVRSIGAMYAACTNWAGSLVIATTFLTMLENITPTGTFSFFAGLCFIAFFFVYFLLPDTAGLELEETTDFLSNGFNVKQAAQLSKERKKHSKFAKSKPTV

SEQ ID NO: 19120 - protein, 250 aa, Salmonella enterica subsp. enterica serovar Paratyphi A str.
MAVTKLVLVRHGESQWNKENRFTGWYDVDLSEKGVSEAKAAGKLLKEEGFSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWTDTILPRMKSGERVIIAAHGNSLRALVKYLDNMSEDEILELNIPTGVPLVYEFDENFKPLKHYYLGNADEIAAKAAAVANQGKAK

SEQ ID NO: 19121 - protein, 92 aa, Colwellia psychrerythraea 34H
MASACALHILVKTEKLAVELKTQLDKGANFGALAKKHSLCPSKKKGGDLGEFRRGQMVKAFDDVVFKRPLLKVHGPIKTKFGYHLIKTLYRS

SEQ ID NO: 19122 - protein, 356 aa, Coccidioides immitis RS
MAAKGTMKAVVFKGPYKVELEDRPIPQIQSPKDIIVKVTYTALCGSELHVFRGHQPSGAGFIMGHEYTGIVTEVGSDVKTVKPGDKIVSPFTSSCGECFYCKRGFSSRCEQSQLLGSATLDGGQAEYVRMPNADGTVMKAPEGINDHALVLMADIFPTGYFAASNAFREFTKEQISELTVVLIGCGPVGLCALINAEDYKPKHLLAVDSIPSRLELARSLGAEPWNYQTDREGLDKRVKELTEGRGADVVIEVVGLSPALKMGFELLRPWGTISSVGVHNGEIPWTGNQAYGKNLKVQMGRCPVRSIFPQALDMLKKKQHLLGFMADKIMPLSQAVEGYGIFDKMQVQKVIFDASQ

SEQ ID NO: 19123 - protein, 589 aa, Arabidopsis thaliana
MGKSEKTSLGRSLVKHHNHMIQESKDKGKYYKNLQKKVLESVTEVSDIDAIIEQAEEAERLYTINHSSSTPLSINLDTNSSSSVIAAEEWREQQKIEEALHASSLQVPRRPPWTPEMSVEELDANEKQAFLNWRRMLVSLEENEKLVLTPFEKNLDIWRQLWRVLERSDLIVMVVDARDPLFYRCPDLEAYAQEIDEHKEIMLLVNKADLLPTDVREKWAEYFRLNNILFVFWSAIAATATLEGKVLKEQWRQPDNLQKTDDPDIMIYGRDELLSRLQFEAQEIVKVRNSRAASVSSQSWTGEYQRDQAVVGFVGYPNVGKSSTINALVGQKRTGVTSTPGKTKHFQTLIISDELMLCDCPGLVFPSFSSSRYEMIASGVLPIDRMTEHREAIQVVADKVPRRVIESVFIISLPKPKTYERQSRPPHAAELLKSYCASRGYVASSGLPDETKAARLILKDYIGGKLPHYAMPPGMPQADEPDIEDTQELEDILEGSESDDSAVGDETENEQVPGIDDVLDDLSSFDLANGLKSSKKVTAKKQTASHKQHKKPQRKKDRTWRVQNTEDGDGMPSVKVFQKPANTGPLTMR

SEQ ID NO: 19124 - protein, 247 aa, Glycine max
  misc_feature (58)..(58): Xaa can be any naturally occurring amino acid
  unsure (1)..(247): unsure at all Xaa locations
NEIVQMLRLPDSHEGNHHNIPMKGGQALRREPYSRTLDERFIRILKIFKWGPDAEKAXEILKIGVEVSVKVQFFKWAGKRRNFEHDSTTYMALIRCLDEHRMFGEVWKTIQDMVNRALSVFYQVKGRKGRPTVSTYNSVMQEGHHEKVHELYNEMCSEGHCFPDTVTYSALTSAFAKLNRDDSAIRLFAEMKENGLQPTAKVYTTLMEIYFKVGCRVEEAFGLVEEMRAWRCLPTVFTHTEFIGGMG

SEQ ID NO: 19125 - protein, 462 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVYGFWCTGTERHY

SEQ ID NO: 19126 - protein, 273 aa, Aspergillus nidulans FGSC A4
MAELIEKAKRAAGKAAVENHYPKDAKFVGIGSGSTIVYVVEAIKELGIDTSGTCYVPTGFQSKQLIVSAGLTAVDFDAIPEGTVLDIAFDGADEVDDELNLIKGGGACLFQEKIVALQAKEFICVADSRKLQSRLLSNWKYIPIEVAPIAAKRVLPALRQLGSINPVLRPQTGSKLGPLKTDQDFYIIDAPFPTLLTKADVAAGKDGSGKDGIWEVDALSLAIKQIPGVLDVGIFSGVTGPQAQALGGIGGQKPVAAYFGMPDGSVQVRKADA

SEQ ID NO: 19127 - protein, 448 aa, Listeria innocua
MAKHRYLPMTEQDEKEMLEVIGVKSIDDLFQDIPEKIRFKRDYDLKPAKSEPALLRELSKLASKNANTSEYASFLGAGVYSHYIPTVVDHVISRSEFYTAYTPYQPEISQGELQAIFEFQTMIAELTGMDLANSSMYDGGTALAEAAMLASGHTKRKKILISGAVHPESINVLKTYATGQHIEVEVIPEVDGKTDIDVLKKALSDDIAGFVVQYPNFYGQVEPLAELEKLVHENNSLLLVSSNPLSLGLLTPPGEFGADIVVGDSQVFGIPESFGGPHCGFFAVTNKLMRKVPGRLVGETVDENGKRGYVLTLQAREQHIRRDKATSNICSNQALNALASSVAMATLGKTGLVEMAKQNLDKSHYAKQKFRENGFEVLFSDGFFNEFVVKLSKPIKEVNESLLDEGIIGGYDLGFYDAKYEQHMLVAVTEMRTKEEIDAFVASLEGVK

SEQ ID NO: 19128 - protein, 418 aa, Streptomyces toyocaensis
MLAGLAVTFAVAFVFARLAKRIRQPRVMGEIIAGLALGPSLLGLLPGDPVEALFPADARPVLQALSQLGLVLFMFGIGYELDFALLRGAGSRVTLVSLSSMALPMALGAGLAVLLFPLYDKSQLSSDGVLAPAIFLGVAMSITAFPVLARIIAENGMQRTRIGAMALACAVVQDFLAWCVLAVAVVIATASGLWPLARMVLESGLFLGVLLYVVRPGLRRLLAPERRRAVGSSLIHAILVTGLLVSAWATHEIGLHAVFGAFAFGAVVPHRHIEVQAPQVVERIEQTSLFLLPVFFTVTGLSVDVGGLGRTGLIMTVAVVLVACTGKYVGAAVSARLTGASKAESRTLGVLLNARGLTELVILNVGLGLGVLDSRLFSAMVVMALVTTFMTGPLLHRLGFHEELRLVPAPVKNADNSV

SEQ ID NO: 19129 - protein, 345 aa, Bradyrhizobium sp. BTAi1
MKALVYHGPGQKSVDERPKPTILEPGDAVVKILKTTICGTDLHILKGDVPTCTPGRILGHEGVGVVEAVGSAVRAFKPGDHVIISCISACGTCDYCRRGMYSHCRHGGWILGNKIDGTQAEYVRTPHADTSLYHVPPGTEEEALVMLSDILPTGFECGVLNGKVEPGSTVAIVGAGPIGLAALLTAQFYSPAEIIMIDLDDNRLEVAARFGATSTINNADGKAVEKVMALTHGRGVDTAIEAVGVPATFVTCEDIIAPGGTIANVGVHGVKADLHLEKLWDRNIAITTRLVDTVTTPMLLKTVQSKKLEPKLLITHRFRLDQILDAYETFGAAARTHALKVLIEA

SEQ ID NO: 19130 - protein, 337 aa, Burkholderia vietnamiensis G4
MSIARRTTLSKFLIEQQRETNNLPADLRLLIEVVARACKAISYNVSKGALGDALGTAGSENVQGEVQKKLDILSNEILLDANEWGGNLAAMASEEMETFFPIPANYPRGEYLLVFDPLDGSSNIDVNVSIGTIFSVLRCPHGKQATEESFLQPGTEQVAAGYAVYGPQSVFVLTTGNGVNCFTLDREVGSWVLTQSNMQIPADTREYAINASNARHWYEPVQRYVSELNAGKEGPRGDNFNMRWIASMVADVHRILNRGGIFMYPADKRTPDRPGKLRLMYEANPMSFIVEQAGGAATTGTQRIMEVQPTGLHQRVPVFLGSKNEVERVTAYHNEGK

SEQ ID NO: 19131 - protein, 338 aa, Glycine max
MGKVKIGINGFGRIGRLVARVALQRDDVELVAVNDPFITTDYMTYMFKYDSVHGHWKHHDVTVKDEKTLLFGDKPVTVFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDSRSSIFDAKAGIALNKNFVKLVSWYDNEWGYSSRVIDLLVFVAKKSF

SEQ ID NO: 19132 - protein, 102 aa, Arabidopsis thaliana
MASGSLKSLISSAVGRGVTEARARIFGHMLNPTGQRSPHKILRKKLIGDKVAEWYPYDIKNEDPNVLAREEKERISKLEMLKRRDKGPPKKGHGKRAAKRNK

SEQ ID NO: 19133 - protein, 355 aa, Haloarcula marismortui ATCC 43049
MRAAVLEAYGEPLAVRDRDPPTPNPDGAVVAVEACGICRSDWHAWQGHGDWADDDVPIGQVLGHEPAGRVTATGNQVTTVSVGDRVVVPFNLGDGTCGYCRNGHGNVCTDGWALGFESDAPGAFAEQVAVPQADYNLVGLPDGVSSDAAAALGCRYVTAFHALAHRADIAAGDRVAVHGCGGLGLAAVQIASALGASVIAVDIRDEPLAMARDAGASTVVDASAVEDVPAAIEGETDGGAEVSVDALGRAETCQNSVRSLRPRGTHVQVGLTTNAERGEVALPTDWITRWDIDVLGSRGMPPSRYDELLRLVADGPLDPGALVTRRVALEAVSERLAAMTDYGTDGIELVTEFGR

SEQ ID NO: 19134 - protein, 251 aa, Bacillus anthracis str. 'Ames Ancestor'
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEVVSPAAAEAVRIQYGGSVKPENIKEYMAQSDIDGALVGGASLEPASFLGLLGAVK

SEQ ID NO: 19135 - protein, 551 aa, Magnaporthe grisea 70-15
MRLSAELAVLASSLWILVGAEPAPTDQQCSPFPGVKGTVTTCDKPQQIAIIGAGAAGASAAYHLTQFASDANIPINITVFEKTTRIGGRTLTVNAYDDPEHPVELGASIFIELNHILYNAANHFKLPLKTPGPEEDEYLVIWDGSRFRFESRDSQWNWWKLVKLFWKYGQAPYKAQQLMKATIAEFLKLYEEPYFPFRSLTTTAYELGLTKITGLTGTQYLDQNNIGSSFSEDVIQAATRVNYASNLGRIHGLDAMVSIAPDGASQVTGGNWQIFDHMLKATNASLHLNTTVTSIEFDKADDDSSILGYVLETSKDSSGSIASSSQRFDKVVIATPYQFSNIHTGEEVLQRPIDEIPYVKLHVTLFTSPLRLSPAFFNLPADAEAPTTVLTTLGEGDDASSGAGKAGFFSISNQRSLTNPATGKTEFIYKIFSPEKVTTEFMSSLLGVQVPESVTAQRTESEAKSWKGTGPVTWYYPHVFYSYPQALPRVTFQDPILGPGLYYTSGMESFISTMETNALMGKNVARLVVDSLLGHKADVGEDKDRVVIGEL

SEQ ID NO: 19136 - protein, 169 aa, Zea mays
MAPTVMMASSATAVAPFQGLKSTASLPVARRSSRSLGNVSNGGRIRCMQVWPAYGNKKFETLSYLPPLSTDDLLKQVDYLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 19137 - protein, 276 aa, Streptomyces sp. TP-A0274
MTQQSDTTADSVGEVYDQFADAGASTAMGGNIHVGYWDDDDPEVPIAEATDRLTDLVAERLALRPDRQLLDVGCGIGVPALRIAGAHDVRVTGITVSQQQVTEAAARAVESDAGGRVSFRLADAMDLPFEDVSFDGAFAIESLLHLPDQTPALKEIHRVVRPGGRLVIADLCQRQPFTGADKEVLDGMLLMYEIAGINTPEEHHARLAEAGWELLELTDIGEQVRASYGHAAAAFRGLAGALDAGAAQQMNAAADLMEAFGGHPYAGYVLITAQRS

SEQ ID NO: 19138 - protein, 255 aa, Cynodon dactylon
AIDWIWKVIEHYNFAPLTAVLSVNYLDRFLSTYEFPEGQAWMTQLLAVACLSLASKVEETFVPLPLDLQVAEAKFVFEGRTIKRMELLVLSTLKWRMQAVTACSFIDYFLHKLNDHGAPSMLARSRAADLILSTAKGAEFLVFRPTEIAASIALAAMGELRSSVLERAATGCKYLNKDNVSRCYGMIQEKITLGNIALKSAGSSLSSVPQSPIGVLDAGACLSQQSDDATVGSSPATCYHSSSTSKRRRISSRLI

SEQ ID NO: 19139 - protein, 182 aa, Pisum sativum
MSYYHHHHHHDYDYPTTENLYFQGAMDPEAELERTFIAIKPDGVQRGLISEIISRFERKGFKLVGIKVLIPTKQFAQQHYHDLKERPFFNGLCDFLSSGPVIAMVWEGEGVITYGRKLIGATDPQKSAPGTIRGDLAVVVGRNIIHGSDGPETAKDEIKLWFKPEELVSFTSNSEKWIYGDN

SEQ ID NO: 19140 - protein, 3971 aa, Bacillus subtilis
MYTSQFQTLVDVIRNRSNISDRGIRFIESDKIETFVSYRQLFDEAQGFLGYLQHIGIQPKQEIVFQIQENKSFVVAFWACLLGGMIPVPVSIGEDNDHKLKVWRIWNILNNPFLLASETVLDKMKKFAADHDLQDFHHQLIEKSDIIQDRIYDHPASQYEPEADELAFIQFSSGSTGDPKGVMLTHHNLIHNTCAIRNALAIDLKDTLLSWMPLTHDMGLIACHLVPALAGINQNLMPTELFIRRPILWMKKAHEHKASILSSPNFGYNYFLKFLKDNKSYDWDLSHIRVIANGAEPILPELCDEFLTRCAAFNMKRSAILNVYGLAEASVGATFSNIGERFVPVYLHRDHLNLGERAVEVSKEDQNCASFVEVGKPIDYCQIRICNEANEGLEDGFIGHIQIKGENVTQGYYNNPESTNRALTPDGWVKTGDLGFIRKGNLVVTGREKDIIFVNGKNVYPHDIERVAIELEDIDLGRVAACGVYDQETRSREIVLFAVYKKSADRFAPLVKDIKKHLYQRGGWSIKEILPIRKLPKTTSGKVKRYELAEQYESGKFALESTKIKEFLEGHSTEPVQTPIHEIETALLSIFSEVMDGKKIHLNDHYFDMGATSLQLSQIAERIEQKFGCELTVADLFTYPSIADLAAFLVENHSEIKQTDTAKPSRSSSKDIAIIGMSLNVPGASNKSDFWHLLENGEHGIREYPAPRVKDAIDYLRSIKSERNEKQFVRGGYLDEIDRFDYSFFGLAPKTAKFMDPNQRLFLQSAWHAIEDAGYAGDTISGSQLGVYVGYSKVGYDYERLLSANYPEELHHYIVGNLPSVLASRIAYFLNLKGPAVTVDTACSSSLVAVHMACKALLTGDCEMALAGGIRTSLLPMRIGLDMESSDGLTKTFSKDSDGTGSGEGVAAVLLKPLQAAIRDGDHIYGVIKGSAINQDGTTVGITAPSPAAQTEVIEMAWKDAGIAPETLSFIEAHGTGTKLGDPVEFNGLCKAFEKVTEKKQFCAIGSVKANIGHLFEAAGIVGLIKSALMLNHKKIPPLAHFNKPNPLIPFHSSPFYVNQEVMDFTPEDRPLRGGISSFGFSGTNAHVVLEEYTPESEYAPEDGNDPHLFVLSAHTEASLYELTHQYRQYISDDSQSSLRSICYTASTGRAHLDYCLAMIVSSNQELIDKLTSLIQGERNLPQVHFGYKNIKEMQPAEKDNLSKQISDLMQHRPCTKDERITWLNRIAELYVQRAVIDWRAVYSNEVVQKTPLPLYPFERNRCWVEAVYESAKERKEKGEVALDINHTKTHIESFLKTVISNASGIRADEIDSNAHFIGFGLDSIMLTQVKKAIADEFNVDIPMERFFDTMNNIESVVDYLAENVPSAASTPPQESVTAQEELVISGAQPELEHQEHMLDKIIASQNQLIQQTLQAQLDSFNLLRNNSHFVSKESEISQDKTSLSPKSVTAKKNSAQEAKPYIPFQRQTLNEQVNYTPQQRQYLESFIEKYVDKTKGSKQYTDETRFAHANNRNLSSFRSYWKEMVYPIIAERSDGSRMWDIDGNEYIDITMGFGVNLFGHHPSFITQTVVDSTHSALPPLGPMSNVAGEVADRIRACTGVERVAFYNSGTEAVMVALRLARAATGRTKVVVFAGSYHGTFDGVLGVANTKGGAEPANPLAPGIPQSFMNDLIILHYNHPDSLDVIRNLGNELAAVLVEPVQSRRPDLQPESFLKELRAITQQSGTALIMDEIITGFRIGLGGAQEWFDIQADLVTYGKIIGGGQPLGIVAGKAEFMNTIDGGTWQYGDDSYPTDEAKRTFVAGTFNTHPLTMRMSLAVLRYLQAEGETLYERLNQKTTYLVDQLNSYFEQSQVPIRMVQFGSLFRFVSSVDNDLFFYHLNYKGVYVWEGRNCFLSTAHTSDDIAYIIQAVQETVKDLRRGGFIPEGPDSPNDGGHKEPETYELSPEQKQLAVVSQYGNDASAALNQSIMLKVKGAVQHTLLKQAVRNIVKRHDALRTVIHVDDEVQQVQARINVEIPIIDFTGYPNEQRESEVQKWLTEDAKRPFHFHEQKPLFRVHVLTSKQDEHLIVLTFHHIIADGWSIAVFVQELESTYAAIVQGSPLPSHEVVSFRQYLDWQQAQIENGHYEEGIRYWRQYLSEPIPQAILTSMSSSRYPHGYEGDRYTVTLDRPLSKAIKSLSIRMKNSVFATILGAFHLFLQQLTKQAGLVIGIPTAGQLHMKQPMLVGNCVNMVPVKNTASSESTLADYLGHMKENMDQVMRHQDVPMTLVASQLPHDQMPDMRIIFNLDRPFRKLHFGQMEAELIAYPIKCISYDLFLNVTEFDQEYVLDFDFNTSVISSEIMNKWGTGFVNLLKKMVEGDSASLDSLKMFSKEDQHDLLELYADHQLRISSTLDHKGVRAVYEEPENETELQIAQIWAELLGLEKVGRSDHFLSLGGNSLKATLMLSKIQQTFNQKVSIGQFFSHQTVKELANFIRGEKNVKYPPMKPVEQKAFYRTSPAQQRVYFLHQMEPNQVSQNMFGQISIIGKYDEKALIASLQQVMQRHEAFRTSFHIIDGEIVQQIAGELDFNVRVHSMDREEFEAYADGYVKPFRLEQAPLVRAELIKVDNEQAELLIDMHHIISDGYSMSILTNELFALYHGNPLPEIPFEYKDFAEWQNQLLIGEVMEQQEEYWLEQFKQEVPILQLPADGSRAMEWSSEGQRVTCSLQSSLIRSLQEMAQQKGTTLYMVLLAAYNVLLHKYTGQEDIVVGTPVSGRNQPNIESMIGIFIQTMGIRTKPQANKRFTDYLDEVKRQTLDAFENQDYPFDWLVEKVNVQRETTGKSLFNTMFVYQNIEFQEIHQDGCTFRVKERNPGVSLYDLMLTIEDAEKQLDIHFDFNPNQFEQETIEQIIRHYTSLLDSLVKEPEKSLSSVPMLSDIERHQLLMGCNDTETPFPHNDTVCQWFETQAEQRPDDEAVIFGNERCTYGQLNERVNQLARTLRTKGVQADQFVAIICPHRIELIVGILAVLKAGGAYVPIDPEYPEDRIQYMLKDSEAKIVLAQLDLHKHLTFDADVVLLDEESSYHEDRSNLEPTCGANDLAYMIYTSGSTGNPKGVLIEHRGLANYIEWAKEVYVNDEKTNFPLYSSISFDLTVTSIFTPLVTGNTIIVFDGEDKSAVLSTIMQDPRIDIIKLTPAHLHVLKEMKIADGTTIRKMIVGGENLSTRLAQSVSEQFKGQLDIFNEYGPTEAVVGCMIYRYDTKRDRREFVPIGSPAANTSIYVLDASMNLVPVGVPGEMYIGGAGVARGYWNRPDLTAEKFVHNPFAPGTIMYKTGDLAKRLRDGNLIYLGRIDEQVKIRGHRIELGEVEAAMHKVEAVQKAVVLAREEEDGLQQLCAYYVSNKPITIAEIREQLSLELPDYMVPSHYIQLEQLPLTSNGKINRKALPAPEVSLEQIAEYVPPGNEVESKLAVLWQEMLGIHRVGIKHNFFDLGGNSIRATALAARIHKELDVNLSVKDIFKFPTIEQLANMALRMEKIRYVSIPSAQKISYYPVSSAQKRMYLLSHTEGGELTYNMTGAMSVEGAIDLERLTAAFQKLIERHEVLRTSFELYEGEPAQRIHPSIEFTIEQIQAREEEVEDHVLDFIKSFDLAKPPLMRVGLIELTPEKHVLLVDMHHIISDGVSMNILMKDLNQFYKGIEPDPLPIQYKDYAVWQQTEAQRQNIKKQEAYWLNRFHDEIPVLDMPTDYERPAIRDYEGESFEFLIPIELKQRLSQMEEATGTTLYMILMAAYTILLSKYSGQEDIVVGTPVSGRSHMDVESVVGMFVNTLVIRNHPAGRKIFEDYLNEVKENMLNAYQNQDYPLEELIQHVHLLKDSSRNPLFDTMFVLQNLDQVELNLDSLRFTPYKLHHTVAKFDLTLSIQTDQDKHHGLFEYSKKLFKKSRIEALSKDYLHILSVISQQPSIQIEHIELSGSTAEDDNLIHSIELNF

SEQ ID NO: 19141 - protein, 376 aa, Methanothermobacter thermautotrophicus
MDGKREIIETEITMGTVHSAAIEPYRVRLFVEDEIVRDAEITVGVNHRGIERIMEGLPVEKANSLTEKVCGICSGVHLWNSILVAEKGLGVEIPERASYIRIIVGELERIHSHLLYLAHGNEVLGHETFSMRLFYIRETVMELLRLIGGNRVQYGVPIIGGIRPRADLDEMKTQRISEGMDFIEEKVEAFAERFTSDPMVMSRITGVCPISRKDALRLHVTGPTLRATGVEFDLRTEMPCYDPFEFDVITQDGGDVRANLLMRVLEIFESINIIRQALRDLPDGRVVDRNWEMQDTGIVKSYVEAPRGRLYHSYAIEDGRVRGSIIRTPSMSNIGAMQYACIGHHITDAQLGIVQCDPCFTCTDRAIEIIDLNAER

SEQ ID NO: 19142 - protein, 488 aa, Listeria innocua
MNLEETMPLVFERSIPGRIGFSLPESDVPETNAGDYFDEAYLRSTPADLPELSELEIMRHYTNLSNHNFGVDSGFYPLGSCTMKYNPKINEKVARFPGFANIHPNQPESSVQGALELLYDLQTSLVEITGMDEVTLQPAAGAHGEWTGLMLIRAFHEKNGDTKRTKVIIPDSAHGTNPASAAVAGFDVVTVKSNEKGLVDVADLKKVVGEDTAALMLTNPNTLGLFEKDIVEMAEIVHAAGGKLYYDGANLNAIMAKVRPGDMGFDVVHLNLHKTFTGPHGGGGPGSGPIGVKKELIPFLPTPVLTKKDDAYTFDYNYPDSIGRVKPYYGNFGINVRAYTYIRTMGPDGLKLVTEYAVLNANYMMRKLQDAYDLPFDQVCKHEFVLSGNRQKKLGVRTVDIAKRLLDHNFHPPTVYFPLIVGEAIMIEPTETESKETLDSFIDTMLKIAKEAEENPEIVQEAPHSTYVKRLDETRAARKPVLRYQKEV

SEQ ID NO: 19143 - protein, 464 aa, Oryza sativa
MACHISARSRYENYHEIYGGEVESRTSNYADLANKYYDLVTSFYEYGWGESFHFGSRWQGETLRESLKRHEHFLALQLGLKKGMKVLDVGCGIGGPLREIARFRDKNQANYNYSNATNYSSASVTGLNNNAYQISRGKELNFSVGLSETCNFVKVTKARIVMQADFMNMPIPDATFDAAYAIEATCHAPDAVGVYREICRVLKPGQLFALDEWCMTDKYDPGNSRHRSIKAEIELGNGLPDIRTTKQCIQALKDAGFEVVSVKDLAEDSPLPWYLPLDSSQFSLNGFRLTRVGRFITHMLVKTLECLHVAPQGSLRVSSFLETAAEGLVKGANIAVAATSANATAAKAALAPPPPAAALALGAGAVVVEEDELSVVGEEDSGGDDETAGDGAAAAPRLEAAGAGEGASEEEERCGLRTRMLTFWPAAQWPGTPQMKKRWPAALMAILSSPEVCVAIGDELVQLS

SEQ ID NO: 19144 - protein, 146 aa, Oryza sativa
  misc_feature (59)..(59): Xaa can be any naturally occurring amino acid
  unsure (1)..(146): unsure at all Xaa locations
MAYMRVTHRDEEGKKVTEKVPIPETRRPDTARHFERKLEEQGFHRLERHPANGPARAGXRRAAPKSGRGGKFTWEGPDGPVDAQLQPAPPAVDPNDPNYDEGDGAGVDEEVAKEVVIGEVEVAKVAEARDGVDVVAPAPLLQQEQQ

SEQ ID NO: 19145 - protein, 444 aa, uncultured archaeon GZfos23H7
MEKEAKTKEGVFEAVEKQEVKFVRLWFTDILGQLKSFAITPKELEGAFDEGMGFDGSSIKGFARIDESDMVAKPDPATFQIVPWRPKEHAVARMFCDILQPDGSPYEGDPRYVLKRNLEQLEEEGYTFYIGPELEFFYLEDDKDPEVLDEGGYFDLTTLDAASDLRRDTILTLEEMGIEVEYSHHEVAPSQHEIDLRYKDALTMADQVMTHRIVVKEIAHQYGCYATFMPKPIFGVNGSGMHVHQSLFKGDRNAFFDLNNEYHLSEKGRGYIAGLLRHAPEITSVANQWVNSYKRLVPGYEAPVYISWARRNRSTLVRVPMYKPGKEKATRVEFRSPDPACNPYLAFSVMLAAGLAGIKNKYELPPPTEKDVYTMSKEEKEKEGITSLPGSLIEAISLTENSELMREALGDHVFNNFITSKKVEWDRYRVNVTEWELKEYLGVL

SEQ ID NO: 19146 - protein, 450 aa, Sulfitobacter sp. EE-36
MTLPPKPESRPAKVSLWRYARLFRQDILSAQPARLYRAWMAEFKTPFFRSYLINQPDLIQTVLKTRPDDYPKSDRIGEGLRPLLGNSVFLTNGAIWKRQRRIIDPAFEGGRLRETFPAIWDAAEAAAARLAPHDGAPLEVEAQTSHAAADVIFRTLFSIPIEHHMAREVFDEFKTYQRSQPILNIAAFVPLPRWLPRLFRRDTKRSAAKIRRLITALTAERMEAIKAGTAPDDLATKIMTTPDPEDGSTFTTDEMVDQVAIFFLAGHETSASALAWAMYLVATHPDWQDRLAAEAQAIDQCDFAVMGKLKQSRDVFREALRLYPPVPMMVREASCPATFRDRTVARGAQVVISPWHLHRHERLWDNPDGFDPARWHSENGKKCQREAYLPFSAGARVCPGAGFAMVEGPLILSRILRDYRIEVVGEKPPIPVAHLTVRSKDGILLRFVRR

SEQ ID NO: 19147 - protein, 296 aa, Agrobacterium tumefaciens str. C58
MLAAEGIDVVENGFGRPMTFDELSARLGDVDAVIAGVDTWNERVFNLAPRLKAIARFGVGVDNIDIDAAHRHGIAVTNAPGGNANAVAELTLGLILSAMRRIPYLHDALRGGAWDRFVGQELIGRRVGLLGFGNIARKIARKLCGFDVEVIAYDKFPDQVAATKLGVRMCEMDEVLSSSDILVMMMPSLPETRRLMDAGRFARMKPGSIFINTARGALVDEKALYDALVSGHLQAAAIDVYETEPALPDNPLFTLPQIVTTPHTAAETYETYTSIGRITAEAVIDVLANRQPRNQL

SEQ ID NO: 19148 - protein, 448 aa, Arabidopsis thaliana
  misc_feature (222)..(222): Xaa can be any naturally occurring amino acid
  misc_feature (370)..(370): Xaa can be any naturally occurring amino acid
  unsure (1)..(448): unsure at all Xaa locations
MGTTTTTSAVYIHVIEDVVNKVREEFINNGGPGESVLSELQGIWETKMMQAGVLNGPIERSSAQKPTPGGPLTHDLNVPYEGTEEYETPTAEMLFPPTPLQTPLPTPLPGTADNSSMYNIPTGSSDYPTPGTENGVNIDVKARPSPYMPPPSPWTNPRLDVNVAYVDGRDEPERGNSNQQFTQDLFVPSSGKRKRDDSSGHYQNGGSIPQQDGAGDAIPEAXNFECDAFRITSIGDRKVPRDFFSSSSKIPQVDGPMPDPYDEMLSTPNIYSYQGPSEEFNEARTPAPNEYQTSTPVAVQNDIIEDDEELLNEDDDDDELDDLESGEDMNTQHLVLAQFDKVTRTKSRWKCSLKDGIMHINDKDILFNKXQQASLTSDLNTSNDASRKVLQIPTERDMSIHGKVYSGWLVVQKEKFFLSKKAYQLSPCFMNSYCLSRNGKLTSQKKKK

SEQ ID NO: 19149 - protein, 315 aa, Zea mays
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNMVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 19150 - protein, 386 aa, Haloarcula marismortui ATCC 43049
MTMDFASRVERVEPSATLAISNKAAELEAEGKDVVDLSVGEPDFDTPENIKDAAKDALDAGHTGYTSSNGIPELKEAIANSLHDDGLTQYGPDNLIVTPGGKQALYEIFQTIIDDGDEVALLDPAWVSYEAMAKLAGGTLTRVNTAAHDFQLEGALDDLADAVSDETELLVVNSPGNPHGAVYSRDALEGVRDLAVEHDITVISDEIYKEITYDGVEAVSLGTLEGMEDRTITLNGFSKAYSMTGWRLGYFAAPEELVSQAGKVHSHSVSCAVNFVQHAGVEAITNTDDAVEEMRQAFAERREFLMGLFEDHGVHVPEPQGAFYMMPEIAPDGDDTEWCDQAISEAQVATVPGTAFGTPGYARISYANSKERLQEAVDRLAEADLI

SEQ ID NO: 19151 - protein, 203 aa, Triticum aestivum
  misc_feature (163)..(163): Xaa can be any naturally occurring amino acid
  misc_feature (196)..(196): Xaa can be any naturally occurring amino acid
  unsure (1)..(203): unsure at all Xaa locations
MAAAKENYRVELRAAARQLGDRCLYSASADAWELLVGIEPDATPSQSAAMDTPSSSGAAPGGRLLHLHRSGGSSFRRRMRSGGGAASEAGTPLGGVSYVSTPIPDDDAFDAGADKYLLAKTYFDCREYRRAAHVLRSQVGRKGRVLRCYALYMAGERRKEEEXNELEGSLGKSNVVNQELVALERELSTHRRTGAXDSFGSVL

SEQ ID NO: 19152 - protein, 346 aa, Neisseria meningitidis MC58
MKAMVYHGANDIRFEEKPRPQIIDPTDAVVKIVKTTICGTDLGIWKGKNPEVADGRILGHEGIGIVEEVGEAVKNIKVGDKVIISCVSKCCTCDNCKTQLYSHCRNGGWILGYMIDGTQAEYVRTPYADNSLVPLPDNVNEEIALLLSDALPTAHEIGVQYGDVKPGDTVFIAGAGPVGMSALLTAQLYSPAAIIVCDMDENRLKLAKELGATHTINPASGEVSKQVFAIVGEDGVDCAIEAVGIPATWNMCQDIVKPGGHIAVVGVHGQSVDFKLEKLWIKKLAITTGLVNANTTEMLMKAISSSSVDYTKMLTHHFKFSELEKAYDVFKHAAENQVMKVVLEAD

SEQ ID NO: 19153 - protein, 894 aa, Musa acuminata
MNSVRSGFLIQAAFLVMISGSSNMGVSGLGSMSSIAVSYGENGPVFCGLSSDGSHLVACFGADASIVYGAPLRLPLLGLTAGDGFVCGLLLDTGQPYCWGSNIFVKMGVPQPMAEGASYSEISAGDDHLCALRKPAIDSRKGASLIDCWGYNMTASHEFDGSVAAITAGSVFSCGMFIHNRTAFCWGDETSSGVISLTPRNLRFQSISAGGFHVCGILENSQVFCWGRSLETQQLSLGHGDVKMVPMDPMVSVAGGRFHACGIKSLDHKAVCWGFMLQNSMPPPKDSRLYEIAAGDYFTCGVLAATSLRAVCWGTGVPWSIPMAVSPGICASNPCGQGYYEFSHTSWGNKVCKPADSRVCLPCSVGCPEGTYESTPCNLTSDHGCEFNCSSCASVECSSFCSSQKESKSKRLLSLQMPIFIAEIVFAIIFVSSVFLVACLYARHRLQSCRCLESAVTTSRKRTYSFHKEMVKVRPDLEELKIRRAQMFTYGELEKATSGFSEESLVGKGSFSCVFKGVLKDGTVVAVKRAIRVSDVKKNSKEFHTELDLLSRLNHAHLLNLLGYCEEGGERLLVYEFMAHGSLYRHLHGKDLCLRKRLDWVRRVTIAVQAARGIEYLHGYACPPVIHRDIKSSNILIDEEHNARVADFGLSLLGPVDSSSPLSEPPAGTLGYLDPEYYRLHYLTTKSDVYSFGVLLLEILSGRKAIDMQFEEGNIVEWAVPLIKAGDISAILDPVLKPPADLEALKKIAAMASKCVRMRGKDRLSMDKVTTTLERALALLMGSPCNEQPILPTEVVLGSSRLHNKASQRSSNRSCSENDTDDQIYEYRAPSWITFPSVTSSQRRKSSASEGDAEGKNSEGRSLGHGGAGDGLRCLEEEIGPASPQENLFLQHNF

SEQ ID NO: 19154 - protein, 421 aa, Arabidopsis thaliana
  misc_feature (296)..(296): Xaa can be any naturally occurring amino acid
  unsure (1)..(421): unsure at all Xaa locations
MALSSLLRSAATSAAAPRVELYPSSSYNHSQVTSSLGFSHSLTSSRFSGAAVSTGKYNAKRVQPIKATATEAPPAVHRSRSSGKTKVGINGFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAXAKAVGKVLPELNGKLTGMAFRVPTPNVSVVDLTCRLEKDASYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 19155 - protein, 648 aa, Robiginitalea biformata HTCC2501
MNQVAIHRLLAGKSLAKPSKKDLPALFEKRLAANLTLIQDLYYSLYPGQDAAFEELPGMLGKLFRDRSEDLRLQDLERLNEGAWYQSEKWVGMQLYTDRFSGDIRGLIDKLPYFEKLGVNFLHVMPLTRQPKGENDGGYAVSSHTEIDPRFGTEADFLEFTGACRDKGVCLMLDFVVNHTSDQYPWAQKAREGDAEYAGYYYMFPDRTLPDLYEETLPEIFPETSPGNFTFIPETGQWVMTVFNQYQWDLNYTNPRVFLAMLKNMVVLANKGVDVLRFDALAFLWKKLGTNSQNLPEAHQLIALFRLCLQVVAPGVAILAEAIVAPREIVRYFGEGRLAGNECEAAYNATYMACLWNSIATKKTNLLYRSLADIASIPESCSWINYIRCHDDIGLGFDDRQIEALGWNPAAHRRFLLDYYCQRLEWSPSRGVLFMYNPVTGDGRITGSTASLLGLEEALDSGNAADVETAFDKIVMMYGVILASAGIPLIYAGDEIGMLNDYSYLREKDKENDSRWVNRPIHDWEAVAALDDPNRLPSRIFSRLQSLIRLRRKLPSLGGGKSVLHHPGNEHLYVFERKAEKGSLLVVANFDENPQVLNATWVRNLGYLKGSAYTNLVDGTSHSVQSALLEIRPYGLLWLKTVEGAGAK

SEQ ID NO: 19156 - protein, 280 aa, Streptomyces sp. TP-A0274
MTDSTQTLPVPEAVGELYDRLTLSAMNDGSFNPNVHIGYWDTPGSEATIEEAMDRLTDVFIERLNAYATSHVLDLGCGVGGPGLRVVARTGARVTGISISEEQIRTANRLAAEAGVADRAVFQHGDAMKLPFADASFDAVMALESICHMPDRQQVFTEVSRVLRPGGRIVLTDIFERHPRKAVRHPGIDKFCRDLMSTTADIDDYVALLHRSGLRLREIVDVTEQTTLRLADEIGRLAAVEERPVAMDEGNFDFGDDSFKPSDLAGVDDFGCLLVTAERP

SEQ ID NO: 19157 - protein, 527 aa, Glycine max
MPSSHLLLEEPIRMVSILEPSKPSFFSAMTKIVGTLGPKSRSVETISGCLKAGMSVARFDFSWHDPEYHQETLENLKAAIKSTKKLCAVMLDTVGAEMQVVNKSEKAISLEANGQVVLTPDQGQEASSEILPINFDGLAKAVKKGDTIFIGQYLFTGSETTSVWLEVSEVKGQDVVCIIKNTATLAGSLFTLHASQIHIDLPTLTEKDQEVISSWGVKNKIDFLSLSYTRHAEDVRQAREFLSKLGDLSQTQIFAKIENVEGLTHFDEILQEADGIILSRGNLGIDLPPEKVFLFQKSALYKCNMAGKPAVLTRVVDSMTDNLRPTRAEATDVANAVLDGSDAILLGAETLRGLYPIETISTVGRICSEAEKVFNQDLYFKRTVKYVGEPMTHLESIASSAVRAAIKVKASIIICFTSSGRAARLIAKYRPTMPVLSVVIPRLKTNQLKWSFSGAFEARQSLIVRGLFPMLADPRHPAESTSATNESILKFALDHGKALGVIKSHDRVVVCQKLGDASVVKIIELED

SEQ ID NO: 19158 - protein, 1115 aa, Mesorhizobium sp. BNC1
MNTMEKVASELMSPEEAEAVQVVPPAGPRPPDWYKDAVIYQLHIKAFHDSNGDGMGDFNGLMQRLDYVERLGVNTIWLLPFYPSPLRDDGYDIADYRSINPSYGTMRDFRRFVAEAHRRGIRVITELVINHTSDQHPWFQRARHAKKGSAARQFYVWNDDDERYPETRIIFLDTEKSNWTWDPVAGQFFWHRFYSHQPDLNFDNPRVLDAVIRIMRFWLDMGVDGLRLDAIPYLVERDGTNNENLPETHEILKKIRKALDEKYPDRMLLAEANQWPEDTRPYFGEGDECHMAFHFPLMPRIYMALAQEDRHPISDIMRQTPEIPESCQWAIFLRNHDELTLEMVTDRERDYLWRTYAEDVRARINLGIRRRLAPLMQNDRRKIELMNALLFSMPGTPIVYYGDELGMGDNIYLGDRDGVRTPMQWAPDRNGGFSRANPQMLYLPPIMDPVYGYQTINVEAQEADPSSLLNWVRRVIGVRKQHSAFGRGDFTMLYPRNRRILAYTRSDANETILCVANLSRSPQAVELDLSKYRNCVPIELVSQSPFPPIGDLPYMLTLTGYGTFWFVLASEAQAPEWHNNVPEPLPEFITLTMVDGRIERALEGRERRQLEQDVLPQFMQRQRWYGAKGEGIRSAGISDIAKLGDEGGLLTIVDVDLSVSGRQRYLLPLTVLWGEENVQFGAPKLSVTLARVRKGSRLGALIDGAYDDRFASELMRRMQENQEMQVPGGTLRFYGNEQLTAMHFEETPSPLMGEQSNVSVAFDRQVLLKIFRRLRPGDQPEVEVARFLTEVAGFRNTPAFLGMVEYEEQGARTVLASVSGFVENQGDAWGVFVHALERQIEDETLAPPAPAGATPAEGTTAQLLYPLDLLRRLGERTGEMHAALAIETDMEAFRCEPIRRADIASWVKDLKQQAASARAALERNKDRLPLNIRESVEHLLSLRQRIDRRISEFGKITPSGKKSRIHGDYHLGQVLVSKQDLYIIDFEGEPRRSLEERRGKSSPLRDVAGMLRSFDYAAWTAVRQVAARLPDQTRDGSSLARQWRERMSAEFLEGYRAAASVAQNQPADGATWEALLELFLLQKGFYEINYELSNRPDWVGIPVQGVLDLIERRSG

SEQ ID NO: 19159 - protein, 390 aa, Triticum aestivum
  misc_feature (150)..(150): Xaa can be any naturally occurring amino acid
  misc_feature (154)..(154): Xaa can be any naturally occurring amino acid
  misc_feature (173)..(173): Xaa can be any naturally occurring amino acid
  misc_feature (188)..(188): Xaa can be any naturally occurring amino acid
  misc_feature (225)..(225): Xaa can be any naturally occurring amino acid
  unsure (1)..(390): unsure at all Xaa locations
NKFVQKSRLVPVRNSRDIVDPRVRANSAALLHSLLSTAWTPRRRLDRASATRLAPSPGLSCRSSRPTRSVRPMASSTTAARADAAPPGLKEGIAGLYDESSGLWESIWGEHMHHGFYDSGEAASMSDHRRAQIRMIEEALAFGAVPDDPXNKPXTIVDVGCGIGGSSRYLANXYGAHCSGITLSPVQXAERENALPAMQGLSDKGSFQSADALEQHFPEGQFDLXGPMESGEHMPNKQKFVSELARVAAPGATIIIVTWCHRNLAPSEDSLKPDELNLLKKICDAYYLPDWCSPSDYVKIAESLSLEDIKTADWSENVAPFWPAVIQSALTWKGLTSLLRSGWKTIKGALVMPLMIQGYKKGLIKFSIITCRKPQAAIEGEPEAASPSVE

SEQ ID NO: 19160 - protein, 491 aa, Coccidioides immitis RS
MSQMAPSQSLQAALSSVQEAFVKRNPQSNQAHKEACRYFPGGNTRSVLYTTPFPLSFQSGHGSTLTSVDGDTYTDFLGEYSAGIFGHSNPQIAEALAGVLSRGWNFGGVNSHEAILARKVCERFNLEMVRFTNSGTEANMMALAAALAFSARNHPGRPEPKSIVVFSNAYHGSTLSFPNTLVDEIRRGHDVSHLTPNLPHNFLIAPWNNPAETAELLATRPRGSIAAILVEPLQGAGGCRPASAHFLKTLRALADQKSALLIVDEVMTSRLATRGLAQEWALRPDLITLGKWIGGGMSFGAFGGRRDVLQLFDPRTTKVPLGHAGTFNNNVLSMAAGCAGLDVYSGQRVARLNELGSTLKARLHALLADASLCEPPANRTDNDNDDDDDDAQRYPLETDSNSDTNDVPPTPPPGRMYVSGYGSVLSIRFSGPDATTCHQLFFHHMLEEKIYLAARGYMALSLELSRADIEHFIAAVQRFVTKYAALLLKDG

SEQ ID NO: 19161 - protein, 339 aa, Zea mays
  misc_feature (91)..(91): Xaa can be any naturally occurring amino acid
  misc_feature (122)..(122): Xaa can be any naturally occurring amino acid
  unsure (1)..(339): unsure at all Xaa locations
MAKIKIGINGFGRIGRLVARVALQSDDVELVAVNDPFISTDYMTYMFKYDTVHGQWKHHEVKVKDSKTLLFGEKEVAVFGCRNPEEIPWGXSVGAEYVVESTGVFTDQEKAEDHLKGGAKKXVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNITK

SEQ ID NO: 19162 - protein, 109 aa, Zea mays
  misc_feature (13)..(13): Xaa can be any naturally occurring amino acid
  misc_feature (29)..(29): Xaa can be any naturally occurring amino acid
  misc_feature (80)..(80): Xaa can be any naturally occurring amino acid
  unsure (1)..(109): unsure at all Xaa locations
TVGIGERYEQRGXKLAAIKLVTASKEHPXTHYEDLVGEPFFPGLGAYKASGPICDMAWEGPDFVKTGRVLLGATNPLVSXPGTIRGDNDIHLGRNVGHGFYSVQICPEG

SEQ ID NO: 19163 - protein, 394 aa, Zea mays
LGAERRARLPPGQMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNCGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 19164 - protein, 314 aa, Aspergillus nidulans FGSC A4
MSLADTTYKLNTGAEIPALGLGTWQSAPGEVSAAVYHALKVGYRHIDAAQCYGNETEVGEGIKRALSEGIVKRSEIFVTTKLWCTYHTRIQQALDLSLSKLGLDYVDLYLVHWPLAMNPNGNHDLFPKLPDGSRDLVREHSHVTTWKGMEELITNNPDKVKAIGVSNYSKRYLEQLLPQAKIVPAVNQIENHPALPQQEIVDLCKEKGILITAYSPLGSTGSPLFKAEAIVAVAERRGVTPASVLLSWHLARGSSVLAKSVTPSRIEENRKLVKLEPEDVELIGKYSAELAATNGFQRYVYPPFGVDFGFPDKS

SEQ ID NO: 19165 - protein, 560 aa, Haloarcula marismortui ATCC 43049
MSLEKPSRDTALDVGVTEDGLDYDALADLLGGHVLDREEHVNAEGFVIRPDEVQEVLSTLKEEAGFDHCACVTAQEYDDRYESIYHLRKYNDPTQELSIVVPSPKDDPHNESAARVYDTADWHEREAYDLVGIDYDDHPDLRRILLPETWQGHPLSQDYNQDQPQIVSLREHANPLKDDKRSEDDPDTMFVNIGPHHPATHGVLHVETVLDGEQIADLEPDIGYLHRCEEQMCQQGTYRHQIMPYPDRWDYISAGILNEWAYARAAEDLADIDVPEYAQVIRTMSAEMCRIASHELALATFALDVFGDFTAVFQYGIRDREIVQNLLEDLTGQRLMFNYLRLGGVAWDLPEPREEYFEKIRDFLDDLPHKLEEIHDLVTGNEIFQMRCVDTGVLSPDQVKQYGATGPVARGSGVDYDIRRDDPYGYYDELDWNVVTEQGGDNFSRVLVRLREVEESARIIEQCVDLLEQWPEDDREIQANVPRTLRPDPDKEIYRSVEGAKGELGIYIRSDGTDKPARFKIRSPCFSNLQTLPEMSQGEYIPDMIASLGSLDIVLGEVDR

SEQ ID NO: 19166 - protein, 520 aa, Arabidopsis thaliana
MAESAGESYRLLSVSSSTTFLAFIIIFLLAGIARRKRRAPHRLPPGSRGWPLIGDTFAWLNAVAGSHPSSFVEKQIKKFVSLLCSVLLLILKRPDNSGFNEIRYGRIFSCSLFGKWAVVSADPDFNRFIMQNEGKLFQSSYPKSFRDLVGKDGVITVHGDQQRRLHSIASSMMRHDQLKTHFLEVIPVVMLQTLSNFKDGEVVLLQDICRKVAIHLMVNQLLGVSSESEVDEMSQLFSDFVDGCLSVPIDLPGFTYNKAMKARKEIIRKINKTIEKRLQNKAASDTAGNGVLGRLLEEESLPNESMADFIINLLFAGNETTSKTMLFAVYFLTHCPKAMTQLLEEHDRLAGGMLTWQDYKTMDFTQCVIDETLRLGGIAIWLMREAKEDVSYQDYVIPKGCFVVPFLSAVHLDESYYKESLSFNPWRWLDPETQQKRNWRTSPFYCPFGGGTRFCPGAELARLQIALFLHYFITTYKSVHVMLLKWTQLKEDRISFFPSARLVNGFKIQLNRRDSDPPNQ

SEQ ID NO: 19167 - protein, 285 aa, Gossypium hirsutum
MEVPFFPTLFSCIKGLVVQQALFSTLEDWLVKHPKILQFSWENGQTPASSHRFLTLTVLSYISFTFVLSQLSRPSLSHPLLKSIAAVHNIFLLTLSFTMALGCLVSIFSQVPNFNTLVCFPRGTSPSGPLFFWAYIFYLSKIVEFMDTLLIILSGSMKRLSFLHVYHHSMVVIMCYICLDSAQSSVPMVLITNCVVHVVMYSYYLLCTLGMHPKWKKMVTDFQLVQFRLSFLIMAMLVFYHFTASGCSGILSWCFNGAFNVSLLYLFSDFHAKSYSTNAKVFKGN

SEQ ID NO: 19168 - protein, 248 aa, Solanum tuberosum
MLAVFEQSIGKPPSELSTQKKEAKTEEEIAESFKSWKPDSTFYHLSNGNFMAFSHENENPLHPRSIVVMDDIFCIFSGGLDNTFDLRKHYGLSRQATEAMIMVEAYKVLRDRAPYPPDQVIKELEGKFAFILFDSKASTLFLARDRDGSVPLHWGIATDGSLVCSDDSEFIQASCGKLYTPFPPGCIFISDTGLISFDHPMHKVKGIAREDDEGNVNAVIFQVDLYTKLHSIPRRGSAANWAGATTVE

SEQ ID NO: 19169 - protein, 251 aa, Bradyrhizobium japonicum USDA 110
MTDAIRPLIAGNWKMNGLKASAAEFDAMLNGAADVATKADLLVCPPATLIAAFADKARGKKVAVGAQDCHPKASGAHTGDIAAEMLANAGATAIIVGHSERRADHGEGDALVRQKAEAAWRAGVTAIVCIGETQAQRDAGQTLDILRGQLDGSLPDGSTAANLVVAYEPVWAIGTGLTPTVQDVEQIHGFIREFLTSRFSVDGAKMRILYGGSVKPSNAAELMAVKNVNGALVGGASLKAADFLAIAKGCP

SEQ ID NO: 19170 - protein, 319 aa, Solanum nigrum
MGSKYSKATNSINDASNSSYRVPFESLRVPFVDLQEATNNFDDKFLIGWGVFGKVYMGVLRNGTKVALKKHMPESSQGIEEFRTEIEILSLCSHPHLVSLIGYCDERNEMILIYEYMENGNLRSHLYGSDLPAMSWEQRLEICIGAARGLHYLHTSAVIHRDVKSINILLDDNFVPKITDFGLSKTGTELDQTHVSTAVKGTVGYLDPEYFIRGQLTEKSDVYSFGVVLFEVLCARPAIAHSHSREMISLAEWAVESHNNGQLEQIIAPNIAAKIRPESLKKFGETVVKCLALSSEDRPSMGDVLWKLEYALRLQESVI

SEQ ID NO: 19171 - protein, 464 aa, Saccharophagus degradans 2-40
MENVVPVILSGGSGSRLWPKSRKAYPKQLHRLYGDATMLQHTVKRVDHLGAPIVVCNNDQRFMVADQLQETCGDASQIILEPIGRNTAPAIAVAAMRAVQQVGDNAIIVILAADHLIKDMPGFRATLDIAIKKATEGKLVTFGVVPTHPETGYGYIKAAEPLAGNTQGATVAEFVEKPNLETAQKYLAEGSYTWNSGMFVFPAKTLLEELTRLNAELVKQSQISLDKSEQDLDFIRLNEQAFAQCQDISIDNALMEHTNKAWVVPLNAGWSDLGSWQSLWESSDKDEYGNVVVGDAYMRNCTNSLIHSDGRLVAAIGLDDVVIIDSDDALLVVNKNKTQDVKHVVDWLKANNRSESQHHREVHRPWGSYDSIDSGERYDVKSLKVKPGASLSLQMHHHRAEHWVVVRGTAQVERGDEKFLVTENESVYIPLGEPHRLTNPGKVPLYLVEVRSGEYLGEDDIVRL

SEQ ID NO: 19172 - protein, 328 aa, Zea mays
MAATRSTTAVPELALPSGNARPVPVIGLGTAVMFQPPETTKDAVLAAIELGYRHFDTASLYGTEKPLGEGVAEAVRRGLIESREEVFVTSKLWCTQCHPDLVVPSLRQTLENLQMDYLDLYLIHMPVCQKPGPPVFPARREDARPFDFKGVWQAMEECQRLGLARAIGVSNFRTKHLDKMMPFATITPAVNQVEVNPVCQQLKLRGYCAEKGIHVQAFSPLGGQSWAAERNAVLESEVLAEIAKARGKTVAQVSLRWVFEQGVSFVVKTYKKERLKENLEIFDWELTDEDRVKISRIPQKKLSGFSFMFKPEGEFTSVDVSEINPIEE

SEQ ID NO: 19173 - protein, 394 aa, Zea mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19174 - protein, 277 aa, Chlamydophila pneumoniae TW-183
MTRSSPAQLSRFLSEIQNKPKKSLSQNFLVDQNIVKKIVATSEVIPQDWVLEIGPGFGALTEELIAAGAQVIAIEKDPMFAPSLEELPIRLEIIDACKYPLDQLQEYTTLGKGRVVANLPYHITTPLLTKLFLEAPDFWKTVTVMVQDEVARRIVAQPGGKDYGSLTIFLQFFADIHYAFKVSASCFYPKPQVQSAVIHMKVKETLPLSDEEIPVFFTLTRTAFQQRRKVLANTLKGLYPKEQVEQALKELGLLLNVRPEVLSLNDYLALFHKMQAG

SEQ ID NO: 19175 - protein, 394 aa, Zea mays
  misc_feature (210)..(210): Xaa can be any naturally occurring amino acid
  misc_feature (214)..(214): Xaa can be any naturally occurring amino acid
  misc_feature (219)..(219): Xaa can be any naturally occurring amino acid
  unsure (1)..(394): unsure at all Xaa locations
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELIYGVRAMAINLPGFAYRGALRARRRLXGALXGVLYXSPAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 19176 - protein, 254 aa, Chlamydophila pneumoniae TW-183
MTRQSYVLGNWKMHKTIQEAKEYVQTLASLLQGEPLSCTIGIASPFTSLRAIHEMINTTGAFLWLGAQNVHPELSGAFTGEISLPMLKEVGVEFVLVGHSERRHIFGESDAFIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 19177 - protein, 394 aa, Zea mays
LGAERRARLPLGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 19178 - protein, 348 aa, Thermosynechococcus elongatus BP-1
MTDYAAHQQALDRDCLTLSRHVLQQLQSFDAAAQDLSALMNRIALAGKLIARRLSRAGLMEGVLGFTGAVNIQGEDVKKMDVYANEVFIAAFKQSGLVCRLASEEMAQPYYIPENCPIGRYTLLYDPLDGSSNVDINLNVGSIFAIRQQEGTDLDSTAADLLQDGHQQIAAGYILYGPSTMLVYSLGKGTHVFVLDPSLGEFILAIENLQIPASGAIYSVNEGNFWAWEEPIRNYVRHVHRQPGYSARYSGALVADIHRILMEGGVFLYPGTQKNPAGKLRLLYEAAPIAFLVEQAGGKASTGTQPLLDVVPDHLHMRTPLIVGSPENVALVESFIQQTPAQPTVTQV

SEQ ID NO: 19179 - protein, 159 aa, Zea mays
  misc_feature (104)..(104): Xaa can be any naturally occurring amino acid
  misc_feature (114)..(114): Xaa can be any naturally occurring amino acid
  unsure (1)..(159): unsure at all Xaa locations
MCQFSCFSAEMLVNLQVPWVILGHSERRALLGESSDFVADKVAYALTQGLKVIACIGETLEQREAGTTMDVVAAQTKAIAEKISDWTNIVLAYEPVWAIGTGKXVATPAQAQEXVHDGLRKGLHSNVSPAVAELTRIIYGGSTTTNIFNCVASQFFTIC

SEQ ID NO: 19180 - protein, 757 aa, Oryza sativa
MRGAVLVAVAAAIGNYLQGWDNATIAGAVLYIKREFALETQPAVEGLVVAMSLIGATIITTFSGPVSDLVGRRPMLIASSLLYFAGGLIMLWSPNVYVLLLARLVDGFGVGLAVTLVPVYISETSPPEIRGRLNTLPQFTGSGGMFMSYCMIFAMTLSPSPNWRIMLGVLFVPSLLYLFVTVFYLPESPRWLVSKGRMKEARVVLEMLRGREDVSGEMALLVEGLGTGGDTEIEDYVVGPSEGDAGENEQARDTVTLYGPEQGLSWVAQPVAGGRGSMLGSSLGLQASRHGSMYEQMKDPVVALLGSVHERLPESGGGATGSMRGSTLFPNLGSMLSVNDRPGGSSWDEENVQPGDDDLDEEEEEYLSDDGKDDDDGGGLQAPLLSRQSTDVETKNEPASGQVAMQRHSSIGGGGGVETASTMGIGGGWQLHASGTENVGPDGVKRGAVKRMYLHEESEAAPGGDSGAAGDAQSTAYVHAAALVSRSMLYTKDVLIGQSPTEPAFANPPEAVAAAASTGPAWRELLEPGVRHALFCGVTIQILQQFSGINGVLYYTPQILDQAGVSVLLASLGLSGDSTSILISGLTTLLMLPSIGVAMRLMDASGRRALLLWTLPVLVASLAVLVVANVVPMAATAHAALSTGSVIVYFCCFVMGFGPIPNILCAEIFPTRVRGLCIAICSLTFWLGDIAVTYSLPVMLSSVGLAGVFSFYAAVCCVALVFVALKVPETKGLPLEVIIEFFNVGAKAGTLPDEEFH

SEQ ID NO: 19181 - protein, 400 aa, Candidatus Pelagibacter ubique HTCC1002
MKIRPVILCGGAGTRLWPNSKNHQAKQFIDFGNWTLLGKTLERVKSSTFDVPIISTNLKYLKEVKKHLKKHKISKYKIVLEPAKRNTAPAILASALIKDIPNEQPLMFFAADHLIEKANIFNKAINKNKTNLTDQNIFIFGIKPTSPSSEYGYFLTKKVKGNINKVTKFIEKPKEAKAKQVIKQKGYWNSGMFFLRKDSIINNFKKYQPTMYKNCLNAVSKAKLKDNTYYLNKTSFEKATAKSFDYAILEKTKQINAIKLDIPWSDLGSWKEILKMYDKNKNKYYKKKNVYYRPWGRYVNLFEGKGFLIKELFVKPKGVLSLQKHHHRSEHWFVTQGTPKITLNKDSFFRKKNDHIFIPLEAIHRIENKGTKPVKIIEAQVGSILKEGDIVRFQDVYGRT

SEQ ID NO: 19182 - protein, 280 aa, Rhodopseudomonas palustris CGA009
MFAMTSSAQSPLQQLGGTVVLAGAGKMGGALLTGWLAQGLDGGDVVVIEPHPTEEIAALSARGVRLNASAGDVGAVSTLVVAVKPQMFAEAAAALRGYVGPSTLVVSIMAGKPIAALSEQLGGHVVRAMPNTPAAIGRGITVAVAAGNVTAAQRGIADALLRATGGVEWVDDEALIDAVTAVSGSGPAYVFLLAEELARAGVEAGLPEGLAMTLARATVAGSGELLHRSDLDAATLRKNVTSPGGTTAAALEVLMANDGFRPLLTRAVAAATKRSKELAK

SEQ ID NO: 19183 - protein, 316 aa, Kineococcus radiotolerans SRS30216
MPRTPQLSLPDLSGRRALVTGASDGIGFGIARRLAGAGAEVLLPVRNRTKGEAALARIREQHPTAKVTLHDLDLSSLSSVAALGDELRAEGSPIHLLINNAGVMTPPQRQTTVDGLELQLGTNHLGHVALVAHLLPLLRAGRARVTSQISVAARSGAVHWEDLNWEDSYHGMRAYSSSKIALGLFGLELDRRSRAEGWGITSNLSHPGVAPTSLLAARPELQRERNTPQIAVIRRLSRAGILVGTVDSAQLPALHAATAPQAQGGRLYGPTGPGNLGGGPGEQPLYRPLRDQTEADRVWTVSQALAGVSFTTTARI

SEQ ID NO: 19184 - protein, 494 aa, Rhodococcus sp. RHA1
MTTATAFAPTTGTQAVPTGLLIDGTWQGAADGRTFEVENPATGEVLSVIADGGPADADAALAAAVAAQESWARTAPRARSEILRRAYDLVMARQDWLAEIMTSEMGKPLAEAKGEVAYAAEFLRWFSEEAVRIGGDHTTTGDGANRIIVTREPVGPCVLITPWNFPLAMGTRKIAPAVAAGCTMVLKPAAQTPLTSLALAAIMQEAGLPDGVLNVVNTTNAGSVVEPWMSSGKARKISFTGSTAVGKLLLKQAADAVMRSSMELGGNAPFIVCADADIDTAVDGAIAAKMRNMGEACTAANRLYVHRSIADVFSERLAARMADMQVGNGLDEGVQVGPLIDAAGRDKVQTLVDDALGRGAKALTGGAVPAGAGYFYPPTVLTDVSTDSDLMTTEIFGPVAPVVPFDDENEVIRIANDTDWGLVGYVFSQDIDRAFDLSERLEVGMVGVNTGIVSNPAAPFGGVKQSGLGREGGKLGIDEFLEYKYLAVPRRRGA

SEQ ID NO: 19185 - protein, 558 aa, Salmonella enterica subsp. enterica serovar Typhi Ty2
MHHATPLIATIVGGLVLAFILGMIANKLRISPLVGYLLAGVLAGPFTPGFVADTKLAPELAELGVILLMFGVGLHFSLKDLMAVKSIAIPGAVAQIAVATLLGMALSAVLGWSLMTGIVFGLCLSTASTVVLLRALEERQLLDSQRGQIAIGWLIVEDLVMVLTLVLLPAVAGMVEKGDVGIASLAVDMGITIGKVVAFIAIMMLVGRRLVPWIMARSAATGSRELFTLSVLALALGIAFGAVELFDVSFALGAFFAGMVLNESELSHRAAHDTLPLRDAFAVLFFVSVGMLFDPLVLIQQPLAVLATLAIIVFGKSIAAFFLVRMFGHSPRTALTIAASLAQIGEFAFILAGLGMALNLLPQAGQNLVLAGAILSIMLNPVLFTLLEKYLAKTETLEEQTLEEAIEEEKQIPVDICNHALLVGFGRVGSLLGEKLLAAGIPLVVIETSRTRVDELRERGIRAVLGNAANEEIMNLAHLDCARWLLLTIPNGYEAGEIVASAREKSPDIEIIARAHYDDEVKYITERGANQVVMGEREIARAMLELLETPPAGEVVAS

SEQ ID NO: 19186 - protein, 159 aa, Plantago major
MLQRIGIGLVLSLVSIVYAAIIERKRLATAMEYGLVDMPKAVVPMSALWLAPQYVLSGVADVFTMIGLQEFFYDQIPCDLKSIGLAMYLSILGIGSLLSSFLVSFIQNMTKGHGQDGWFADNLNKAHLDYFYWLLAGLSTVGLSAYIYFARSYVYRRKV

SEQ ID NO: 19187 - protein, 340 aa, Candidatus Kuenenia stuttgartiensis
MEKPADKSEKKAPASQFEKTWVSTFPRVCEGCSQLTNKQFFLINPVLKITTIGTFIKNANAKFVLSKIIVEDFYEGEIYLLLSLKLAITIGNILLLLEDEAIKENANKENFDADCADGFKEFSNQVCGILDNDLRLKLPKPIHLKLLSVEPINKENMTTVLKDDILNEECLFLSTSLRIMGFDDDQFIICVPKLIGEEFFGEIIEEENKEYRGTILAVDDSNTDLRIIRKLLGNDYKVLVTDNPGHALSTLGKTNIDLVLMDIYMPGVDGITLCERIKRNAMVEDVPIIICSAHPTQENVIRAVRAGAADFIVKPVTRQKLMEKINKHMLNKSLKIPANR

SEQ ID NO: 19188 - protein, 523 aa, Methanococcus maripaludis S2
MSKILITDPLHESAVEILKQAGEVEVATGLTVEELKLKIKDVDALVIRSGTTATREIIEASENLKVIARAGVGVDNVDLDAATEKGIVVVNAPDASSISVAELLFGMMLAAARNIPQATASIKSGKWDRKSFKGMEIYGKTLGIVGLGRIGQQVAKRAQAFGMTIVAYDPYIPEDVASELGIKLLTVDELCTVSDFITLHVPLTPKTKHMIGKEQIALMKSNMVIMNCARGGLIDEAALYDALNSGKIKAAALDVFEQEPPKESPLLTLNNLIGTPHQGASTEEAQLSAGTIVAEQTVKILKGESAENVVNLPMVPTEKMKKLKPYMVLAEKMGSMAIQYLDNSIELLEITYMGGLAKEKTEILKRSFLKGILAPILLAGVNLVNAPVIAKSRNIKIAEGTMSESDYGNSIKISAKGENDEISIIGSIEHNEVVFREINGYRMDIKPEGTICIIKHIDRPGMVGKVGVLLGEHGINIAGMQVGRREPGGHSIMFLDIDHMISDEVLDEIRKMENVRAAKSINI

SEQ ID NO: 19189 - protein, 505 aa, Sulfitobacter sp. EE-36
MNTPKPVVLCILDGWGLRDDPQGNAPLLAKTPHVDRIMQSCPSATLTTFGPDVGLPQGQMGNSEVGHTNIGAGRVVAMDLGQIDLAIEEGAFATHQPLLDFAETLKQTGGTAHVMGLVSDGGVHGHLTHMIAAVRTLRAQGIPVVIHALTDGRDVAPRSALGYFETLQAALPDGASIATVSGRYFAMDRDNRWDRVAKAYEAIVQGKGSAAPTARDAVNDAYGLDENDEFITPTVLEGYTGVQDGDGIFCLNFRADRAREIMSALADPEFDAFDTGARPAWSAVMGMAEYSDAHGAFMTTMYPKPEIVNTLGAWVAQHGLRQFRLAETEKYPHVTFFLNGGEETPTTGEDRYMPKSPNVATYDLQPEMSCAEVTDRFVQAIKDRYDLIVVNYANPDMVGHTGDLDAAIAACEAVDTGLGRVLEALEDVGGAMIVTADHGNCETMIDPETGGAHTAHTLNPVPVAVVGGPDGASLRSGRLADLAPTVLQLMGLDQPAEMTGKSLLE

SEQ ID NO: 19190 - protein, 347 aa, Schizosaccharomyces pombe
MASVTSEKCVILSDGTEYDVTNYLVANKDAADLLRRYHRQEVADILNATSKSKHSEAVVEILKSAKVPLKNKEFSDLVDQNIGVGYGNEFIVKPTDLDKDFEKNHFLDLKKPLLPQILFGNIKKDVYLDQVHRPRHYRGSGSAPLFGNFLEPLTKTPWYMIPLIWVPCVTYGFLYACTGIPFSVAITFFIIGLFTWTLVEYTMHRFLFHLDEYTPDHPIFLTMHFAFHGCHHFLPADKYRLVMPPALFLIFATPWYHFIQLVLPHYIGVAGFSGAILGYVFYDLTHYFLHHRRMPNAYLTDLKTWHLDHHYKDYKSAYGITSWFWDRVFGTEGPLFNEQGKISTKAK

SEQ ID NO: 19191 - protein, 394 aa, Zea mays
  misc_feature (86)..(86): Xaa can be any naturally occurring amino acid
  unsure (1)..(394): unsure at all Xaa locations
LGAARRARLPPGEMGWPLVGGMWAFLRAFKSGKPDAFIASFVRRFGRTGVYRSFMFSSPTVLVTTAEGCKQVLMDDDAFVTGWPKXTVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19192 - protein, 394 aa, Zea mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGISGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19193 - protein, 255 aa, Desulfitobacterium hafniense DCB-2
MAKRHPIIAGNWKMNKSLRETQEYAVKLLGVLGEVTAIDVVVCAPFTALNVLKNELEESVIHIGAQDMFYAPDGAYTGEISAAMLVDVACTYVILGHSERREILRETDEEIAKKVKAALKAGLTPILCVGENLANREEGKAFAIVRGQVEKDLTDLAPDDLKRVVIAYEPIWAIGTGKTASSEDAQEMCAMIRSTLAGIAGVVADEVNILYGGSVKADNIGELMSQPDVDGALVGGASLEAEGFAQLVQNAVAVL

SEQ ID NO: 19194 - protein, 511 aa, Desulfitobacterium hafniense DCB-2
MKPLLLMILDGWGYNPQSAGNAVAKAPKPHFDRLLEEYPHTLIVASGEEVGLPPGQMGNSEVGHLNIGAGRVVYQEFTRISQAIRTGEFARNTVLQEAMERVKDGPNALHLMGLLSDGGVHSHSEHLFALLAMAKTMGVKKVFIHALLDGRDVLPQSAKGFMTQLNSKCRELGLGQVATVSGRYYMMDRDKRWERVEKGYRALVNGEGLKAPNSLAAIEQSYDVRVTDEFVAPTVIVDSAGEAVGPLRDGDSFIFFNFRSDRAREISYALLDEEFTGFDRGRPLQLHYVCMTEYDDKLKGAAVAFPAQNLDNTLGEVLAKHQKKQLRIAETEKYAHVTFFFNGGVEEPCPGETRCLIPSPQVPTYNLLPEMSAYGITEELLKRLEREEDEVIILNFANADMVGHTGEFEATVKAIAAVDQCIGQIVPQVLERQGTVIITADHGNAEAKVDLQTGQPLTAHTTNPVPLILVNDQLKGKTLREGGALRDVAPTMLRLLEIPQPQEMTGKSLIC

SEQ ID NO: 19195 - protein, 394 aa, Zea mays
LGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFINRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 19196 - protein, 228 aa, uncultured cyanobacterium
HEVAGAGQHELGMKFAELIQAADNTMTYKYVVRNVAKKYGKTATFMPKPVFNDNGSGMHVHQSLWKGGQPLFFGEGTDANLSQTARWYIGGILKHAPSFLAFTNPTTNSYKRLVPGFEAPVNLVYSEGNRSAAVRIPLTGPNPKAKRLEFRSGDALANPYLAFSAMMMAGIDGIKNQIDPGAPTNEDLFELSAERLSAIDTVPASLNGALETLNADHHYLMEGGVFTQ

SEQ ID NO: 19197 - protein, 394 aa, Zea mays
  misc_feature (12)..(12): Xaa can be any naturally occurring amino acid
  misc_feature (29)..(29): Xaa can be any naturally occurring amino acid
  misc_feature (36)..(36): Xaa can be any naturally occurring amino acid
  unsure (1)..(394): unsure at all Xaa locations
LGAERRARLPPXDMGWPLVGGMWAYLRAXKSGKPDXFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19198 - protein, 228 aa, uncultured cyanobacterium
HHEVATAQHELGMKFAELIQAADNVMTYKYVVRNVAKKYGKTATFMPKPVFNDNGTGMHVHQSLWKGGQPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 19199 - protein, 314 aa, Triticum aestivum
MGAGDKTAAGMPRIGMGTAVQGPKADPIRRAVLRAIQIGYRHFDTAAHYETEAPIGEAAAEAVRSGAVASRDELFITSKLWCSDAHRDRVVPALRQTLRNLQMEYVDLYLVHWPVSMKPGRFKAPFTAEDFVPFDMRAVWEAMEECHRLGLAKAIGVANFSCKKLETLLSFATIPPTVNQVEVNPVWQQRKLREFCRGKGIQLCTYSPLGAKGTHWGSDAVMDAGVLQEIAASRGKSVAQVCLRWVYEQGDCLIVKSFDEARMRENLDVDGWELTEEEHRRIAEIPQRKINLGKRYVSEHGPYKSLEELWDGEI

SEQ ID NO: 19200 - protein, 228 aa, uncultured cyanobacterium
HEVAGAGQHELGIKFAELIQAADNVMTYKYVVRNVAKKYGKTATFMPKPVFNDNGSGMHVHQSLWKGGQPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 19201 - protein, 228 aa, uncultured cyanobacterium
QHEVATAQHELGMKFAELIQAADNVMIYKYVVRNVAKKYGKTATFMPKPIFADNGSGMHVHQSLWKASQPLFFAPGTYANLSDTARWYIGGILKHAPSFLAFTNPTTNSYKRLVPGFEAPVNLVYSEGNRSAAVRIPLTGPSPKAKRLEFRSGDALANPYLAFSAMMMAGIDGIENQIDPGAGVDVDLFELPADELAKIATVPASLNGALEALRADHHYLLEGGVFTK

SEQ ID NO: 19202 - protein, 479 aa, Oryza sativa (japonica cultivar-group)
MTTEVALLRGPTNLASPTSSTLRYLANGDSDVSLPRRSSREEESPAGLQEEEEEEEEERWSFLALLLELLRKSLLRCSTVQEGGGECGMEIGWPTDVQHVAHVTFDRFHGFLGLPVELEPEVPRRAPSASASVFGVSTESMQCSYDSRGNSVPTILLMMQRRLYEQGGLRAEGIFRINAENSQEEFVRDQLNSGIVPDGIDIHCLSGLIKAWFRELPSGVLDSIPPEQVMQCQSEEDCARVAKCLPPAEAALLEWAVNLMADVVQEEQINKMNARNIAMVFAPNMTQMSDPLTALMYAVQVMNFLKMLIQKTLKGRQESNLEDTSLPHKDPSDESGHHKPCLTLESLLEEESRRPSFVEEEPILNSPAHGTGYNPIEVNPVQGKTAASIAQTSEVQTIIEGSSSCSRPSLTDPPATADPVCAEAANSLQRKGSRSLNSRRTRKGKGQSGTSATSSAEKSKGTSIVSRINSKIERIEAWR

SEQ ID NO: 19203 - protein, 452 aa, Novosphingobium aromaticivorans DSM 12444
MRYLPLTDADRSAMLSVVGAGSVDELFADVPAEARLSAPIAGLPNHASEMAVERHMARLSANNVTAGSVPFFLGAGAYRHHVPATVDHMIQRGEFLTAYTPYQPEIAQGTLQVLFEFQTQVARLFGTDVANASLYDGSTACWEAIAMAGRITKRGKALLSGGLHPHYVETARTMARFTGDVLDTSAPVLTAAPDDDALVARIDGETSCVVVQYPDILGRIPDLAKIAAAAQAQGALLITVVTEPVALGVLQSPGSLGADIVVGEGQSLGVGLQFGGPYLGLFGCREKYLRQIPGRLCGETVDADGKRGFVLTLSTREQHIRREKATSNICTNSGLCALAFSIHLTLLGGSGLADMARLSHLAARKTAAALAQVSGIEVVNSHFFNEFTVALPHDARQIVRDLADRHVLGGVSLGRLYPQEAALANGMVVAATECTTDEDIAALVAALKEVLA

SEQ ID NO: 19204 - protein, 228 aa, uncultured cyanobacterium
HEVAGAGQHELGMKFAELIQAADNTMTYKYVVRNVAKKYGKTATFMPKPVFNDNGTGMHVHQSLWKGGQPLFFGEGTEANLSQTARWYIGGILKHAPSFLAFTNPTTNSYKRLVPGFEAPVNLVYSEGNRSAAVRIPLTGPNPKAKRLEFRSGDALANPYLAFSAMMMAGIDGIKNQVDPGAPTNVDLFELSAERLSEIDTVPASLNGALEALNADHHYLMEGGVFTK

SEQ ID NO: 19205 - protein, 223 aa, Brassica napus
MFVSFLDVIYLTSLFFILLSVSQERTMAVGDLSSSSSSSSSQELHVLAVDDSFVDRKVIERLLRISACKVTTVESGTRALQYLGLDGDNGSSALKDLKVNLIVTDYSMPGLTGYELLKKIKESSAFREIPVVIMSSENIQPRIEQCMTEGAEDFLLKPVKLADVKRLTELIMRRGEPQEEDKAKHSYPNRILQNNTDSSSSAHDYVSSVYDDTPSSKRMKLES

SEQ ID NO: 19206 - protein, 277 aa, Bordetella bronchiseptica RB50
MKNDLSIAFIGGGNMAAALASGLAGKVCPAANIHVVDINADSHAGWRARGMSAAAAPDATLAGCRVWVYAVKPQHMREAVAGTRPWLRPDTLIVSVAAGIRADTLAGWLGEPGQPWQRLVRCMPNTPALVGAGMTGLAALPGVTPQDRELAGQLLTSVGEVVWVDGDAGLDAVTALSGSGPAYVFLFIEALIAGGRAVGLTDEQARQLALGTLAGATRLAAQSDEPPAVLRERVTSKGGTTAAALDVYAQGDFAGLVERAMQAAARRSRELAEEFGR

SEQ ID NO: 19207 - protein, 293 aa, Ustilago maydis 521
MPERSTGPMMFIGERCAFEECHRDDFLPFKCSDCRQHYCSSHFRPQAHRCSHYDAHNADYRVPLCPICDNPPEGWKRDQDPNVAMDRHLSGQCPKLDRHGYLKPNATLPKATQIKRIKKTNECSFVKCSKIMVVPITCPQCSASFCPSHRAPNQHSCKHAPPSLSSPASPSSHLTPNVSAANGIKNAFQNLKISNPAAASNKPASTSKHAPSSNTTRPTDASNLSTTSAPFGKMFDKSEKRAKAERLSAVRAMQARQRKGILSKADEIKLAEEMAMLSKTDRMKASDSDCIVM

SEQ ID NO: 19208 - protein, 601 aa, Arabidopsis thaliana
MVEGRRRRRFSLSSQQLALLLLLLSFFLCFSVASPRAISDSDLLDETVANSSSSVASLNASSSSSLVKPKEGSFADIIDRALEKEFNESDQNEVADPGSFNNSVAGQQFEYLNVRLVVVPCGDQAVLETVARVKSTKKNETKEEKRIKRYLIFHRRFQLHDVFNLNNDNRAEDTPTLIDRKVSFYTGRLSLDLLHYFLHGSFGLVLISDLVVVIVSATCGGIAFACAGQPVITGYLLAGSIIGPGGLNFISEMVQVETVAQFGVVFLLFALGLEFSTAKLCGGKRSEGVFVGAFLSMSSTAVVLKFLMEKNSTNSLHGQVTIGILILQDCAVGLLFALLPVLEGNSGIVHGMLSIGKGGFVAFVFGCFVNIITDMYSLVAEANGQLIVTDSHMCVPSLIWSWCVFGNSSDKCSDKLGLSLELGSFAAGVMISTTDLAEHTLEQIEPIRNLFAALFLASIGMLVNVHFLWTHVDILLASVILVIIIKTTIVTTVVKGFGYNNKTALLVGISLAQIGEFAFVLLSRASNLHLIEGKLYLLLLGTTALSLVTTPLVFKMIPAVVHLGILLKWFSPDSTIEKGEIVRSESGKQRMILMSRQSHSS

SEQ ID NO: 19209 - protein, 528 aa, Ustilago maydis 521
MIYAPIAKTQLEWYASLNPLEHGVDNKFFRKTSIIATIGPKTNNVEMLGALRQAGMNIVRLNASHGSHEYFKSVVDNARAVVAKTPGRPLAIALDTKGPEMRTGVMVNGEDVKISMGHEFYVTTDDAYAEKCSLDYLYIDYKNLAQKVEVGRTIFIDDGILSLQVLAIESDKLVKVRAVNNGVLSSKKGVNLPMTEVDLPAISDKDRKDIEFAVEQDLDMIFASFIRRGSDVRTIREILGEKGAHIKIISKVENHQGVQNFDEILKESDGIMVARGDLGIEIPAPQVFMAQKMMISKCNIAGKPVICATQMLESMIVNNRPTRAEVSDVANAVLDGADCVMLSGETAKGAYPIEAVKMMAETAYLAEQSVSYVPLFNEMRTLTSIPTDTNETIAMAAVAASLEQHAGAILLMSTSGTTARLVSKYRPSCPILTITRNSHTARDVHLYRGCYPFLYPHARPEDNSKWQEDVDNRIKYGLAEALALGIIEKGDVVITLQGWRAQSGSTNTIRILSVPESARDFKLEGTQV

SEQ ID NO: 19210 - protein, 336 aa, Arabidopsis thaliana
MDLASNLGGKIDKSDVLTAVEKYEQYHVFHGGNEEERKANYTDMVNKYYDLATSFYEYGWGESFHFAQRWKGESLRESIKRHEHFLALQLGIQPGQKVLDVGCGIGGPLREIARFSNSAVTGLNNNEYQITRGKELNRLAGVDKTCNFVKADFMKMPFPENSFDAVYAIEATCHAPDAYGCYKEIYRVLKPGQCFAAYEWCMTDAFDPDNAEHQKIKGEIEIGDGLPDIRLTTKCLEALKQAGFEVIWEKDLAKDSPVPWYLPLDKNHFSLSSFRLTAVGRFITKNMVKILEYIRLAPQGSQRVSNFLEQAAEGLVDGGRREIFTPMYFFLARKPE

SEQ ID NO: 19211 - protein, 446 aa, Methanococcus voltae
MTSLEMALEYIKINNVKFLRFQFVDIHGEPKNIAYPVKLGTADGEEELMGVLENGLFFDGSSIEGFVEIEDSDMVLKPDLSTLSVLPWRPSEKSVARIICDVYRKNGKPFEGDPRGCLKRVLAEFKEEFKGEYFVGPEPEFFILKNENGKWVPGDDAGYFELEPLDEGNDLRRNIVFALENLGFHVEASHHEVAPGQHEVDFKYDNAVKTADSVITFKTTIKTLAKQSGVLATFMPKPFFGMNGSGMHCNQSIWLDGKPSFYDENNAHQLSDICLSYIGGILEHTKALVSVTNPTVNSYKRLVPGYEAPVNIAWANSNRTSIIRVPAARGKGTRVEFRAPDPACNPYLAFTVMLAAGLDGVRRKLIAPEPVEKNIFAMSEAEKREANIDSVPSNLYDAIEELRQDKVLKKALGDHIFNKFIEIKTKEYDAYRTAVTDWEFNKYVRI

SEQ ID NO: 19212 - protein, 654 aa, Idiomarina baltica OS145
MYGTFASLLMLLAVAVVLVWAFRRIKLPAILAYLTAGVIAGPDVMGWIADPNEYHLIAELGIVLLLFSLGLEFSLPKMLAMRRWVFGLGSAQVLVSLALFMGLGLWLLDSPTAALAVAGALALSSTAVVIKQLSESSQTATRRGQMTVAVLLFQDIAVVPLLIAIPLLAGQGGENIAYSLLLALLKGAAVITVLLLIGKWVLPFLFREIARQRTDELFVLATLLVALVAGGLTHLFGLSMALGAFLAGMMLGESKYKHQLEADIRPFRDILMGLFFTTVGMQLSLHAVVFEFHWIVATLLVMALIKVLLIQGVARMMGEHRRDAWAAAVSLFQMGEFGFVLVSLAASYGLLEPRISSILIGVGVLSMAITPLVIQKLQPLVAFLAHDEGDSSGIHSDQAEEEQAAPALICGFGRVGQTVSRFLEAEGIKHVAIDNDPMRVQEAVAGGAKVYFGDSAKRDILRAVGAQHAPLIVISYADDTYAIKTLKEIRAMNEDAFILVRSRDDSRLTALQEAGASQVVPDTLEASLMLISHVLNRSGVPIRRILTRLEQERRNHYGDMHGFFPGSHTDMDPERLEKLQFLHAVPLPQHAWAVGKSVEDLDWSKRNVELKAIRRDDVEVTDLTDQIELAVDDVVLLSGKPAAVEAAERWLLEG

SEQ ID NO: 19213 - protein, 564 aa, Legionella pneumophila str. Lens
MHDALPLITTIAMGFALALILGFIAVRLKMPALVGYLLAGVTIGPFTPGLMANVEIAQELAEIGVMLLMFGVGLHFSLSDLLRVRKIAIPGAIVQMIVATILGGGTAIMWGWDYGSALIFGLSLSVASTIVLLRALEERGTLESINGHIAVGWLLVEDLAMVIVLVLIPPLSHWLGDNSSVTIHRPLWIVLGLTLIKVTTFIALMFLVGRRFFPKLLWQIARTGSRELFTLCIITAAISIAYVASKLFGVSFALGAFFAGMIMRESSFSHRAAEESLPLRDAFAVLFFVSVGMLFNPAVLVEQPLQVLTVVSIIIIGKSIAAFILVLAFRYPIQSALIISASLAQIGEFSFILAELGIRFDMLPEAGRSYILAGALISIAINPLIFKLINPVHAWVQSHPKLVGILERTDDPLAELPRTTKEEYLSGQVVLVGYGRVGMHIAQLLSKKVVPFVVIDENRELIERLRASGIPAVYGDASEPSVLIQGHIARASMLMTVTSDTIHVRKMIQCAYKLNPDIEIVVRTHNEEEAELLQKEITGKVFFAEGEIAKSMGHYALNRYGKSP

SEQ ID NO: 19214 - protein, 394 aa, Zea mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVNMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19215 - protein, 394 aa, Zea mays
LGAARRARLPPGEMGWPLVGGMWAFLRAFKSGKPDAFIASFVWRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19216 - protein, 394 aa, Zea mays
LGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19217 - protein, 331 aa, Vibrio fischeri ES114
MTIKVGINGFGRIGRFVFRASVERNDIEVVGINDLIDVEYMAYMLKYDSTHGRFNGTVEVVDGNLVVNGKTVRVTAERNPEDRKWDAINVDVVAEATGLFLDDATARKHITAGAKKVVLTGPSKDATPMFVMGVNHESYAGQDIVSNASCTTNCLAPVAKVLNDKFGIESGLMTTVHATTATQKTVDGPSAKDWRGGRGASQNIIPSSTGAAKAVGVVLPELNGLLTGMAFRVPTANVSVVDLTVNLKTAASYEAICAAMKEASEGELKGVLGYTEDAVVSQDFIGEVQTSVFDAAAGVALTDKFVKVVSWYDNEIGYSNKVLDLIAHVSK

SEQ ID NO: 19218 - protein, 519 aa, Novosphingobium aromaticivorans DSM 12444
MNAINPTGWRPSMGENVPAGGVQTFTGNRALQLEEALIFELGQADRSGVDFPETDGIDLSALGPLARAERPDLPGLSEPEAVRHYTRLSRQNYAIDLGLFPLGSCTMKHNPRLDEKVARMPGFADVHPLQPVQTVQGALGVINELAHWLIELTGMHGVAMTPKAGAHGELCGLLCIRAALEAKGDPRNVILVPESAHGTNPATAAFAGFKVENIPATPDGRVDTAALTARLGPDIAGVMITNPNTCGLFERDLKVIADAVHAAGGYVYCDGANFNAIVGRVRPGDLGVDAMHINLHKTFSTPHGGGGPGSGPVVLSEALSPFGPLPFTARQADGSIRLIEEEHAHEEHPQAFGRMCAFHGQMGMFTRALAYILSHGADGLRQVSGDAVLNANYVLRSLDDVLDAPFGAAGPCMHEALFSDDGFAEGFSTLDLAKGLIDEGYHPMTVYFPLVVHGAMLVEPTETESKAGLDQFIGAMRSLAERARAGDEALKSAPHLAPRRRLDETLAARKPRLVWSSQA

SEQ ID NO: 19219 - protein, 230 aa, Brassica rapa
MVGTRVVGQWTLCVASPRLTPAICSSTSSPTTVNLRAELAAFRPQFRLFSRTSPSRRRLRASTSSAESGIFLPHLVASMEQVEETYIMVKPDGIQRGLVGEIISRFEKKGFKLIGLKMFQCPRELAEEHYKDLSSKSFFSSLIEYITSGPVVCMAWEGVGVVASARKMIGKTDPLQAEPGTIRGDLAVQTGRNIVHGSDSPENGKREIALWFKEGELCEWDSVLAKWLRE

SEQ ID NO: 19220 - protein, 501 aa, Oryza sativa (japonica cultivar-group)
MSGATADWAWWLGLVAGAVPLLALAVWHCTDAFHSAAFAFRRRGTRARLPPGHMGLPFVGETLALIWYFNLARRPDAFIEAKRRRYCYGDGDDDGGIYRTHLFGSPAVLVCSPASNGFVFRSAPPGSFGVGWPVPELVGASSLVNVHGGRHARLRRFVLGAINRPGSLRTIARVAQPRVAAALRSWAAKGTITAATEMKNVTFENICKIFVSMEPSPLTEKIHGWFTGLVAGFRSLPLDMPGTALHHARKCRRKLNSVFREELERRKVKMVTGEGGDDDDDGDLMSGLMHVEDEQGRRLDDDEVVDNIVSLVIAGYESTASAIMWATYHLAKSPSALAKLREENLAIAKEKNGDGFITLEDVSKMKYTAKVVEETIRLANIAPMAHRVALRDVEYRGYTIPKGWKVIVWIRSLHVDPAYYDNPLSFNPDRWDKSAELGTYQVFGGGERICAGNMLARLQLTIMLHHLSCGYKWELLNPDAGIVYLPHPRPTDGAVMSFSEL

SEQ ID NO: 19221 - protein, 394 aa, Zea mays
  misc_feature (227)..(227): Xaa can be any naturally occurring amino acid
  misc_feature (233)..(233): Xaa can be any naturally occurring amino acid
  unsure (1)..(394): unsure at all Xaa locations
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFINRTVTSSLRAWADHGGSVEFLTELRRMTFKIIVQIFLGGADQATTRALERSYTELNYGMRAMAINLPGFAYRGALRARRRLVAVLQGVLDERRAARAKXVSGGGXDMMDWLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19222 - protein, 228 aa, uncultured cyanobacterium
HEVAGAGQHELGIKFAELIQAADNVMTYKYVVRNVAKKYGKTATFMPKPVFNDNGSGMRVHQSLWKGGQPLFFGEGTYANLSQTARWYIGGILKHAPSFLAFTNPTTNGYKRLVPGFEAPVNLVYSEGNRSAAVRIPLTGPSPKAKRLEFRSGDALANPYLAFSAMMMAGIDGIKNQIDPGEGVDVDLFELPANQLANIATVPASLNGALEALNADKHYLMEGGVFSE

SEQ ID NO: 19223 - protein, 394 aa, Zea mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 19224 - protein, 228 aa, uncultured cyanobacterium
HHEVATAQHELGMKFAELISAADNVMIYKYVVRNIAKKYGKTATFMPKPVFADNGSGMHVHQSLWKAGQPLFWGEGTYANLSQTARWYIGGLLKHAPSFLAFTNPTTNSYKRLVPGFEAPVNLAYSQGNRSAAVRIPLTGTNPKAKRLEFRSGDALSNPYLGFAAMLMAGIDGIKNQIDPGDGTDVDLFELSAEELAKISTVPASLNGSLEALKADHEYLLAGDVFTA

SEQ ID NO: 19225 - protein, 476 aa, Mycobacterium sp. MCS
MKSVPTGLWIGGEEREAKSTFNVLDPSSDEVLVAVGDATAEDAVAALDAACAVQAEWAATPARKRGEILRSVFETLTDRADDIAALMTLEMGKVLAESKGEVTYGAEFFRWFAEEAVRIGGRYTPSPAGTGRIIVTKQPVGPCYAITPWNFPLAMGTRKMGPAFAAGCTMIVKPAQETPLTMLYLAKLMAEAGLPKGVLSVLPTSSPGPVTEALVDDGRLRKLTFTGSTGVGKSLVKQSADKLLRTSMELGGNAPFIVFDDADVDAAVDGAMLAKMRNGGEACTAANRFHVANSVREEFTEKLVKRMSEVTLGNGLDESATLGPLINNKQLQKVTELVSDAVSRGATVAVGGVAPGGPGNFYPATVLADVPADARILKEEVFGPVAPITGFDSEEEGVAAANDTEYGLAAYVYTRSLDRALRVAEAIESGMVGINRGVISDAAAPFGGIKESGFGREGGTEGIEEYLDTKYIALTK

SEQ ID NO: 19226 - protein, 255 aa, Euglena gracilis
MPRKFFVGGNWKCNGTRESISKIIEEFNKGPSVADADVEVVIGCPFVYADYTREKLRQDWALSVQNCWIGKGGAFTGEISAEMIKDAGIPWVILGHSERRHLPELKESDETVAIKVAYALANGLKVMACIGELLEEREGGQTQAVNERQLKAIAAKLKEEDWKNVVIAYEPVWAIGTGKVATPEQAQEVHEQVRAWVASNVSPSVAAEVRILYGGSVTAKNSAELAGKPDVDGFLVGGASLKPEFLDIVAAYKHK

SEQ ID NO: 19227 - protein, 228 aa, uncultured cyanobacterium
HEVAGAGQHELGMKFAELIQAADNTMTYKYVVRNVAKKYGKTATFMPKPVFNDNGSGMHVHQSLWKGGQPLFFGEGTEANLSQTARWYIGGILKHAPSFLAFSNPTTNSYKRLVPGFEAPVNLVYSEGNRSAAVRIPLTGPNPKAKRLEFRSGDALANPYLAFSATMMAGIDGIKNQIDPGAPTNVDLFELSAERLSEIDTVPASLNGALEALNADHHYLMEGGVFTK

SEQ ID NO: 19228 - protein, 818 aa, Mannheimia succiniciproducens MBEL55E
MLDKDFIYESPKLTVEALKQAIVSKLVFDIGRSAQEATTRDWLNATVYAVRDFVAEGWIQTVNQFREEKTRRVYYLSMEFLMGRVLSNAMLSEGVYDTAKQALSELGLVLEDILEKEADPGLGNGGLGRLAACFMDSIATCNLPGMGYGIRYEYGMFKQTIEDGSQVEKPDAWIAKGAPWEFTRASKRYRVRFGGNLHFEGEKCIWTPSEEITALAYDNIVPGYETKSAATLRLWTANAGDIFNLANFNKGDYFGAIEERSSIENVSRVLYPDDSTWAGRELRLRQEYFLVSASLQDIIKRHKKFHGGKIANLADKVAIHLNDTHPALAIPELMHILVDQEGISWKKAWDMTRRIFSYTCHTLMSEALETWPIELMAKVLPRHLQMIYEINAEFLEYVRTYVSADVDFIRRVSLIEEGNQRKVRMGWLSVVGSHKVNGVAEIHSDLMVSSTFADFAKIYPERFTNVTNGVTPRRWIGVANPKLAALFDKYIGTEWRKDLSQLSLLKPYIGKPEIIGELAKIKFANKKRLARYVKNTLDIEINPNAIFDVQVKRIHEYKRQILNVLQIISRYNQMIANPEKNWQSRVFILAGKAASAYYTAKQTIRLINDIAEVINNDERLKGRLKVVFIPNYSVSIAEIIIPAADISEQISLAGTEASGTSNMKFALNGALTLGTLDGANVEILENVGEDNIFIFGNTVEQVEELRRNGYSPVTFYQQDEELRQAVDQIALGHFSPKEPTRYQGLIDSLRNYDYYQSFADFRSYADMQAKVDEKYQDQAAWFNSTLENIANMGFFSSDRTILEYAERIWKIKPLKLEN

SEQ ID NO: 19229 - protein, 87 aa, Zea mays
  misc_feature (32)..(32): Xaa can be any naturally occurring amino acid
  misc_feature (37)..(37): Xaa can be any naturally occurring amino acid
  unsure (1)..(87): unsure at all Xaa locations
MIKPDGLHRGLIGEIITRFEKKGFYLNAFKLXTWRGXLLEFSTPDHASKPRLQGLVDYIISGPVVAMVREDKSVGTTDLKIIGATNP

SEQ ID NO: 19230 - protein, 470 aa, Vibrio angustum S14
MKKTKIVCTIGPKTESVEMLTKLANAGMNVMRLNFSHGDFEEHGQRIRNLREVMANTGKELAILLDTKGPEIRTIKLEGGQDFSLVAGQDFTFTTDTSVVGNQNCVAVTYPGFAKDLTKGNTILVDDGLIEMEVLETTDTEVKCKVLNNGDLGENKGVNLPGVSVKLPALAEKDKADLKFGCEQGVDFVAASFIRKAEDVQEIRALLTANGGENIQIISKIENQEGVDNFDAILDASDGIMVARGDLGVEIPVEEVIFAQKMMIEKCNRARKVVITATQMLDSMIKNPRPTRAEAGDVANAIMDGTDAVMLSGESAKGKYPIEAVTIMAQICARTDYVVKPELGSRLDSPRLRITEAVCKGAVDTAEKLNAPLIIVATEAGKSARSVRKYFPTARILAVTTNTKTAAQLCLSKGVTPVVVDSIESTDAFYLRGKELALETGLGAKGDIVVMVSGALVASGTTNTASVHVL

SEQ ID NO: 19231 - protein, 228 aa, uncultured cyanobacterium
HEVAGAGQHELGMKFAELIQAADNVMTYKYVVRNVAKKYGKTATFMPKPVFNDNGTGMHVHQSLWKGGEPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADQLAQIATVPASLNGALEALNADKHYLMEGGVFSE

SEQ ID NO: 19232 - protein, 406 aa, Novosphingobium aromaticivorans DSM 12444
MTDKPSVLFICTQDTEEEEARFTRAALEAAGVEVVHLDPSVRRSLGGAEISPEMVAQAGGMTIEEVRALGHEGKCQDAMIRGAIAAAHEWDARHPVSGILAVGGSMGSALAGALMQSFPYGLPKLIVSTMASGFTKPYMGVKDIAMMNAVTDISGINTISRDVFRNAANAVAGMAKGYDRDKGPEKPLVLITTLGTTETSVKRIRQALESDGCEVMVFHSSGAGGPTLDGLAADKDVALVLDLSPTEILDHLFGGLADAGPDRGRAALRKGIPTILAPGNADFIIGGPIDAAEAQFPGRRYHQHNPQLTAVRTNVADLRKLADHLAANVREAKGPVRVFTPLKGFSSHDSETGHLLDLSVPGPFAEYLASVMPGHVPVTAVDAHFNDEAFSSAVIAAAREMLAAKN

SEQ ID NO: 19233 - protein, 228 aa, uncultured cyanobacterium
HHEVATGGQCELGIRFGKLVEAADWLMIYKYCIKNVAKQYGKTVTFMPKPLFNDNGSGMHTHQSIWNGGQPMFAGDRYAGLSQMALWYIGGILKHAPALLALTNPTTNSYKRLVPGFEAPVNLAYSQGNRSASVRIPLSGDNPKAKRLEFRCPDATSNPYLAFAAMLCAGIDGIKNQIDPGDPLDVDIYDLSPEELAKIPSTPGSLLDALKALEADYEFLTSTGVFTP

SEQ ID NO: 19234 - protein, 480 aa, Salmonella enterica subsp. enterica
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTANSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 19235 - protein, 304 aa, Oryza sativa
MAAPSSLASSHLYRLADLRRAGVAAAAPAHPQQLRLGCSRRRAQRVVAMAGSGKFFVGGNWKCNGTKDSVSKLVTELNAATLEPDVDVVVAPPFIYIDQVKNSLTDRIEVSAQNVWIGKGGAYTGEISAEQLVDIGCQWVILGHSERRHVIGEDDQFIGKKAAYALSQNVKVIACIGELLEEREAGKTFDVCFKQMKAFADSITNWADVVIAYEPVWAIGTGKVATPEQAQEVHAAVRDWLKTNVSPEVASGIRIIYGGSVNAANCAELAKKEDIDGFLVGGASLKGPDFATIINSVTSKKVAA

SEQ ID NO: 19236 - protein, 447 aa, Methanococcus maripaludis S2
MVEKSTEYRKTKILVTMGPSLDGTFEKSLEFIDGIRFNMSHTNTKHIEKYLDILNKKNIAKLMDLKGNKIRIKKSNFSELIENQVVKLGKDILISYIPECIKKGQNILINDGKIKLIVESVEKDITARVLVGGHIKEKMGVNFPEGCFPNDLTDEDIKNVKFAVENEFEYIALSFVRSETDILNLKNLIKEYSGNCSVIAKIETKEGLKNIDEILNHSDGVMIARGDLGVEVAIEYLPIIQKNIIKLANEKGKLIITATQMLDSMVNNPYPTRAEVTDVANAIFDGTDCLMLSNETTIGKYPIESIKTLDNIARVSENDISKYKQEIEFEEHSIYSGIAYAVEALSKKLNPKIVITPTTSGKTPLRISKFRFNSPIIALAPENIVFRKLRLVWGVIPIKIDEIGDVDEVLEISKKIAKNIIDSGIYVVTLGHPKGEKKTNVIKVESI

SEQ ID NO: 19237 - protein, 392 aa, Mesorhizobium sp. BNC1
MLQTVAAFDRIGEENAFAVLARATELAHQGRDIINLGIGQPDFHTPEHIVEAAVKALRDGHHGYTPANGILAAREAVARRTLATTGVEVSPENIMILPGGKPTMFAAILMFGEPGAEILYPDPGFPIYRSMIEFTGAKPVPVPIREENGFAFSAEETLSLITPKTRLLILNSPANPTGGVAPREEIARLVKGLEAHPQVAILSDEIYDVMTYDGEKATSLLTFPEIRDRLIVLNGWSKTWAMTGWRLGWSIWPDRLYGLVRKLAVNCWSCVNAPAQYAGIAAIDGPQDDVEKMMRAFASRRKLVVEGLNGLPGVTCLTPKGAFYAFPNIRGTGWKAKKLAAALLDEAGVALVGGPDFGVLGEGYIRLSYANSEENILRAIGRMGDFLARTGQ

SEQ ID NO: 19238 - protein, 476 aa, Bradyrhizobium japonicum USDA 110
MVAKCTTAEDLVKAITDEKVQMIDLRFTDLPGVWQHFSVPPSAVNADALNEGIGFDGSSIRGFQEIQESDMLVVADPTTAFVDPYSPAKTLVLICNIRDPVTGQSYSRDARYIAQKAEIHLKGTGRADTSYFGPEAEFFVFDEVRYAQGINYAMHAVDSSEGSWNTGSEEGPNLGHKPRPKEGYFPVPPTDSMQALRTEMVLTMESLGIQIEAHHHEVATGGQNEIDMRFTTLTRMADNLMIYKYVVKNTAHQHGKTATFMPKPLFEDNASGMHVHQSLWKGETNLFYDKGDYAELSQLGRYYIGGLLSHAWALCGLCAPTTNSYRRLVPGYEAPINLVYSQRNRSACCRIPMYSPNPRAKRVEFRSPDPSCNPYLAFAAMLMAGLDGIDKQIDPGSPIDKNLYDLPPTEAKEVKSTPGSLDQALDALERDHAFLLRGDVFTADVIETWLDYKRKKEVDPIRLRPHPYEFHLYYDI

SEQ ID NO: 19239 - protein, 427 aa, Pseudomonas syringae pv. syringae B728a
MSRSETLFANAQKHIPGGVNSPVRAFKSVGGTPLFFKHAAGAYVTDEDDKRYVDYVGSWGPMILGHSHPDVLDAVRSQLEHGLSYGAPTAMETEMADLVCELVPSMEMVRMVSSGTEATMSAIRLARGFTGRDSILKFEGCYHGHSDSLLVKAGSGALTLGVPSSPGVPAAFAKHTLTVPFNNLDAVRDLLAEVGQEVACIIVEPVAGNMNCVPPAPGYLQGLRELCDEHGVVLIFDEVMTGFRVALGGAQAYYGVTPDLSTFGKIIGGGMPVGCFGGKREIMSHIAPLGPVYQAGTLSGNPLAMAAGLTTLRLISRPGFHDELSDYTRRLLEGLQQRADAAGIPFVTTQAGGMFGLYFSEADEIVTFEDVMTSDSERFKRFFHLMLDGGVYLAPSAFEAGFTSIAHGDAELKLTLDAAEKAFAALK

SEQ ID NO: 19240 - protein, 113 aa, Oryza sativa
MASSSNPDTMDTDPPGGGGTLSIAVERNPPESRLLQLGVKSWPKWGCPTGKFPVKFDARETCYLVKGKVRAHIKGSSECVEFGAGDLVVFPKGLSCTWDVLAAVDKYYKFDSS

SEQ ID NO: 19241 - protein, 382 aa, Daucus carota
MRFTRVYTEVFNMTDHSLLCTETNNLCFDDLEARDDQDPRIDCENVVGNESEALICAVPLQRDEDFVFVFESKVNFCPEVIFSTDRSGELDLCVRKEALDWIYKAHAHYNFGALSVCLAVNYLDRFLSLYELPSGKKWTVQLLAVACLSLAAKMEEVNVPLTVDLQVADPKFVFEAKTIKRMELLVLSTLKWRMQACTPCSFIDYFLRKINNADALPSGSLIDRSIQFILKTMKGIDFLEFRPSEISAAVAICVTREAQTLDINKAMSNIIPVEKDRVFKCIEMIQDLTLVTETSNVASGRTRAQVPQSPVGVLDAACLSYKSDERTVGSCPNSSLHTETSPHTKRRKLIEIMKCGFYSITQFQIFSEWEFWCGCLCKRPPL

SEQ ID NO: 19242 - protein, 394 aa, Zea mays
LGSARRARLPPGEMGWPLVGGMWAFLRAFKSGKPDAFIASFVRRFGRTGVYRSFMFSSPTVLVTTGEGCKQVLMDDDAFVTGWPKATVALVGPRSFVAMPYDEHRRIRKLTAAPINGFDALTGYLPFINRTVTSSLRAWADHGGSVEFLTELRRMTFKIIVQIFLGGADQATTRALERSYTELNYGMRAMAINLPGFAYRGALRARRRLVAVLQGVLDERRAARAKGISGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19243 - protein, 339 aa, Salmonella enterica subsp. enterica serovar Paratyphi A str.
MKSIVIEKPNTLTIETRALPQPAPGEVRIKVKLAGICGSDSHIYRGHNPFAKYPRVIGHEFFGVIDAVGDNVNRDRIGERVSVDPVISCGHCYPCSVGKPNVCTSLVVLGVHRDGGFSEYAVAPARNAHRIPDNIADHHAVMVEPFTIAANVTGQVNPTEQDVALIYGAGPMGLTTVQALKGVYQVKTVIVVDRIEERLAMAKQSGADWSLNNGQHSLAEFLQQKALKPTLIVDAACHPAILQEAITLASPAARIVLMGFSSDPCEIVQQGITGKELAIYSSRLNVNKFPVVIDWLNKGLIDPDKLITHTFDYQHVIDAIELFEKDQRQCCKVLLTFAK

SEQ ID NO: 19244 - protein, 424 aa, Chlorobium tepidum TLS
MKVDFNIDIHHLPRVEGHGDIRISVRDGKLVDAKWAVVETPRFFEVMVKGLSAERVPFLTSRICGICSISHSLASIRSLERAMQITPPETARIIRLLAMHGETLQSHALHLFFLAAPDFMGTPSVVPLMQSHPEVVEAGLLLKELGNELSIATTGRATHPVSLVLGGVSKAPAKQRLAEIKQMIADRKPMLDRATDFFMTLRVPEFVRETEFISLHDGKSYPYIGGNLVSTDGVKRDENDYLAMTNEYTVDFSTSKFTRLSRESSAAGALARFNNNYAQLHPRAKEAAAAFGLEPVCHNPFMNNIAQLVECHHLVADAEELIDRLLDDDLRNIKADYKPRAGAATGAVEAPRGVLYHYMETDESGKVVKGDCIIPTTQNNANIHYDLHALAEQSLAQGMGEKEVEKLCEMLVRSYDPCISCSVH

SEQ ID NO: 19245 - protein, 417 aa, Nocardia farcinica IFM 10152
MGHVSPHLPHRPPRVLEQSTKLQNVVYEIRGPVHAHAARLEAEGHRILKLNIGNPAPFGFEAPDVIMRDIIAALPYAQGYSESKGILSARRAIVTRYELVPGFPEFDVDDVYLGNGVSELITLTMQALLDNGDEVLIPAPDYPLWTAMTSLAGGTPVHYLCDESNGWQPDIADIEAKITDKTKALLVINPNNPTGAVYSAEVLQQIVDLARKHQLLLLADEIYDKILYDDAKHISLATLAPDLLCLTFNGLSKAYRVAGYRSGWMVITGPKEHATGFLEGIDLLATSRLCPNVPAQHAIQVALGGHQSIEDLILPGGRLLEQRDVAWERLNMIPGVSCVKPKGALYAFPRLDPEVYEIHDDSKLILDLLLQEKILMVQGTGFNWPAHDHLRIVTLPWARDLAVAIERFGNFLASYRQ

SEQ ID NO: 19246 - protein, 317 aa, Mycobacterium tuberculosis CDC1551
MCCTSGCALTIRLLGRTEIRRLAKELDFRPRKSLGQNFVHDANTVRRVVAASGVSRSDLVLEVGPGLGSLTLALLDRGATVTAVEIDPLLASRLQQTVAEHSHSEVHRLTVVNRDVLALRREDLAAAPTAVVANLPYNVAVPALLHLLVEFPSIRVVTVMVQAEVAERLAAEPGSKEYGVPSVKLRFFGRVRRCGMVSPTVFWPIPRVYSGLVRIDRYETSPWPTDDAFRRRVFELVDIAFAQRRKTSRNAFVQWAGSGSESANRLLAASIDPARRGETLSIDDFVRLLRRSGGSDEATSTGRDARAPDISGHASAS

SEQ ID NO: 19247 - protein, 394 aa, Zea mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGALDERRAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19248 - protein, 228 aa, uncultured cyanobacterium
HEVATGGQCELGFRFGKLIEAADWLMTYKYVIKNVARKYGKAVTFMPKPIFGDNGSGMHCHQSIWKDGQPLFAGDKYAGMSEMGLYYIGGILKHAPALLAITNPTTNSYKRLVPGYEAPVNLAYSQGNRSASVRIPLSGGNPKAKRLEFRCPDATSNPYLAFAAMLCAGIDGIKNKIHPGEPLDKNIYELSPEELSKIPSTPGSLELALEALENDHAFLTESGVFSED

SEQ ID NO: 19249 - protein, 461 aa, Salmonella typhimurium
MAEKKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVGLVALANLAAVRLYGEIEFWFAMIKVTTIIVMIIIGLGVIFFGFGNGGQAIGFGNLTEHGGFFAGGWEGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAVAKVSRHGVPVAGVALSILILLVGSCLNYIIPNPQRVFVYVYSASVLPGMVPWFVILISQLRFRRAHKEAIADHPFRSIMFPWANYLTMAFLVCVLIGMYFNEDTRMSLFVGVIFLLAVTLVYKVFGLNRHGTAHKVGE

SEQ ID NO: 19250 - protein, 394 aa, Zea mays
  misc_feature (1)..(1): Xaa can be any naturally occurring amino acid
  misc_feature (4)..(4): Xaa can be any naturally occurring amino acid
  misc_feature (29)..(29): Xaa can be any naturally occurring amino acid
  misc_feature (33)..(33): Xaa can be any naturally occurring amino acid
  misc_feature (36)..(36): Xaa can be any naturally occurring amino acid
  unsure (1)..(394): unsure at all Xaa locations
XGAXRRARLPPGEMGWPLVGGMWDFLRAXKSGXPDXFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19251 - protein, 458 aa, Pseudomonas syringae pv. phaseolicola 1448A
MTSQDGLKRGLSARHIRFMALGSAIGTGLFYGSASAIQQAGPAVLLAYLIGGAAVYMVMRALGEMAVHDPVSGSFSHYATRYMGPLAGFVLGWTYAFEMIIVCLADVTAFGIYMGFWFPEVPRWIWVLGIVFLIGALNLCNVKVFGETEFWLSILKVSAIVAMIVAGFGIMIFGIGSSTSGTEIGISNLWAHGGFMPNGVTGLIASFAVVMFAFGGIEIIGITAGEAKDPQRSLPQAINAVPLRILLFYVLTLFVLMCIYPWPQIGTQGSPFVQIFDNLGIASAATILNIVVISAAVSAINSDIFGAGRMMYGLARDGQAPASFARLSRHGVPWMTVLVMGIALLGGVLLNYLIPKDVFLLIASLATFATVWVWLMILLTQVAMRRSMNRDEAAQLKFAVPFWPYGPAAAIVFMLFIFGVLGYFPDNRAALIVGAIWIVLLLIAYGLWVKPKALNNPH

SEQ ID NO: 19252 - protein, 228 aa, uncultured cyanobacterium
HHEVATGGQNELGIRFATLVSAADYLMTYKYVIKNVAKKYGRTVTFMPKPLFNDNGSGMHTHMSIWKEGQPQFWGEGYANLSPMALHAIGGILKHAPALLALTNPTTNSYKRLVPGFEAPVNLAYSQGNRSASVRIPLSGGNPKAKRFEFRCPDATCNPYLAFAAMLCAAVDGIKNEIAPGDPLDVDIYDLSPEELSKIPSTPGSLEAALEALEKDRTFLTDTGVFTQ

SEQ ID NO: 19253 - protein, 228 aa, uncultured cyanobacterium
HHEVATGGQNELGIRFATLVSAADYLMTYKYVIKNVAKKYGRTVTFMPKPLFNDNGSGMHTHMSIWKEGQPQFWGEGYANLSPMALHAIGGILKHAPALLALTNPTTNSYKRLVPGFEAPVNLAYSQGNRSASVRIPLSGGNPKAKRFEFRCPDATCNPYLAFAAMLCAAVDGIKNEIAPGDPLDVDIYDLSPEELSKIPSTPGSLEAALEAVGEGSHFPDGYGVFTQ

SEQ ID NO: 19254 - protein, 480 aa, Pseudomonas fluorescens Pf-5
MQLKDAQLFRQQAFIDGAWVDADNGQTIKVNNPATGEILGTVPKMGAAETRRAIEAADKALPAWRALTAKERATKLRRWYELLIENQDDLGRLMTLEQGKPLAEAKGEIAYAASFIEWFAEEAKRIYGDVIPGHQPDKRLIVIKQPIGVTAAITPWNFPAAMITRKAGPALAAGCTMVIKPASQTPFSALALVELAHRAGIPKGVLSVVTGSAGDIGGELTSNPIVRKLSFTGSTEIGRQLMAECAKDIKKVSLELGGNAPFIVFDDADLDKAVEGAIISKYRNNGQTCVCANRLYIQDSVYDAFAEKLKAAVAKLKIGNGLEEGTTTGPLIDEKAVAKVQEHIADALKKGATLLAGGKSMEGNFFEPTILVNVPKDAAVAKEETFGPLAPLFRFKDEAEVIAMSNDTEFGLASYFYARDLGRVFRVAEALEYGMVGVNTGLISNEVAPFGGIKASGLGREGSKYGIEDYLEIKYLCLGI

SEQ ID NO: 19255 - protein, 228 aa, uncultured cyanobacterium
HEVAGAGQHELGMKYAELIEAADNVMIYKYIVRNVARKYGKTATFMPKPVFNDNGTGMHVHQSLFKGGQPLFFGEGTYANLSQTARWYIGGILKHAPSFLAFANPTTNSYKRLVPGFEAPVNLVYSKGNRSAAVRIPLTGPNPKAKRLEFRPGDALANPYLAFSAMMMAGVDGIKNQIDPGDGFDEDLFELSAERLASIPTVPASLNGALEALNADKNYLMEGGVFTE

SEQ ID NO: 19256 - protein, 467 aa, Pseudomonas putida
MQQAQGLKRGLNARHIRFMALGSAIGTGLFYGSASAIQMAGPAVLLAYLIGGAAVFMVMRALGEMAVHNPVAGSFGHYASTYLGPMAGFILGWTYAFEMVIVAIADVTAFGIYMGFWFPEVARWIWVLGIVFLIGGLNLCNVKVFGEMEFWLSLLKVGAIVAMILAGLGIMAFGFSQVGTGHAVGVSNLFDHGGFMPNGVGGLIASFAVVMFAFGGIEIIGVTAGEAKDPQRVIPKAINAVPLRILLFYVLTLFVLMCLYPWPQIGSEGSPFVQIFSNLGIGSAAAVLNVVVISAAISAINSDIFGAGRMMYGLAHQGHAPRSFGKLSKHGVPWMTVVVMGAALLIGVLLNYLIPENVFLLIASIATFATVWVWLMILLTQVAMRRSMSREEVAQLKFPVPFWPYGPAMAIAFMVFIFGVLGYFPDTQAALIVGVIWVVFLVASYLLWCKPRAGQGQPVAEPVELHR

SEQ ID NO: 19257 - protein, 337 aa, Nostoc punctiforme PCC 73102
MIRVAINGFGRIGRNFARCWVGRENSQIDLVAINDTSDPRTNAHLLKYDSMLGKIKGAEISADDNSIIVNGKTIKCVSDRNPEKLPWRDWGIDLIIEATGVFTSKEGALKHVNAGAKKVLITAPGKNEDGTFVVGVNHHDYDHNIHNIISNASCTTNCLAPIAKVLNDKFGIIKGTMTTTHSYTGDQRLLDASHRDLRRARAAAINIVPTSTGAAKAVALVIPDLKGKLNGVALRVPTPNVSMVDFVVQVEKRTITEEVNQALKDAAEGPLKGILDYSELELVSSDYQGSDASSIVDSSLTLVMGNDLVKVMAWYDNEWGYSQRVLDLAELVAEKWQ

SEQ ID NO: 19258 - protein, 264 aa, Pseudoalteromonas tunicata D2
MAKITVSTLKKMKEEGRKIAALTAYDASFSQLFQDNGIHVLLVGDSLGMVLQGGTDTLGVTNQDIAYHTRCVRAGAKDTFVIADMPFMTYSTVTDTCKHAAELMRAGANMVKLEGGEWLYDSIKALTIQGIPVCGHLGLTPQSVHVFGGFKIQGRENEQANKMVQDAQALERAGAQLLVLECIPSALAERITQSVSIPTIGIGAGKLTDGQILVMHDLVGISAGYIPKFSKNFLLETGNMPAAVKKYLDDVTSGAFPGTEHEFN

SEQ ID NO: 19259 - protein, 228 aa, uncultured cyanobacterium
HEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSASVRIPLTGPSPKAKRLEFRSGDALANPYLAFSAMVMAGLDGIKNQIDPGDGEDRDLFELPAEELAKIATVPPSLNGALEALNADRGFLTAGGVFSD

SEQ ID NO: 19260 - protein, 92 aa, Vibrio vulnificus YJ016
MANTAAALHILVKHKEQAEDIIAQLKKGAKFHVLAKKHSLCPSGKRGGDLGEFKRGQMVPQFDKVCFTGEVLTPHLVKTKFGWHVLKVLYRT

SEQ ID NO: 19261 - protein, 480 aa, Salmonella enterica subsp. enterica
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRDAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 19262 - protein, 480 aa, Salmonella enterica subsp. enterica
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRDAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRYEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRI

SEQ ID NO: 19263 - protein, 176 aa, Gossypium hirsutum
LFSFILILTHFLLKSSIRIQVLGWICVAISVSVFAAPLNIMARVVRTKSVEFMPFTLSFFLTLSAVMWFAYGLFIKDLCVALPNVLGFILGMLQMLLYAIHRHSEKVNIEEKKLPAEQMKSINVVLTTLGASEVHPVVLDIHTDDTKEEDNKNNEPTGEPDKQTDVKMEDANESPV

SEQ ID NO: 19264 - protein, 353 aa, Oryza sativa (japonica cultivar-group)
MEALHEEMPFDLAFHPSSPLVATSLITGELYLFRYAAESQPERLFAAKSHKESCRAVRFVESGNVILTGSADCSILASDVETGKPIARLEDAHENGINRLVCLTETTVASGDDEGCIKVWDTRERSCCNTFHCHEDYISDMTYVSDSTQILATSGDGTLSVSNLRRNKVKSQSEFSEDELLSVVVMKNGKKVVCGTPSGALLLYSWGFFKDCSDRFLGHAQSVDTMLKLDEETLISGASDGVIRLVGILPNRIIQPLAEHSEYPIEALAFSNDRNYLGSISHDKMLKLWDLQDLLNRQQLVQDDKLGEQDSDDSDDDGMDVDMDPNSSKGSRSTKTSKGQSSDRPTSDFFADL

SEQ ID NO: 19265 - protein, 124 aa, Brassica napus
  misc_feature (6)..(6): Xaa can be any naturally occurring amino acid
  misc_feature (14)..(14): Xaa can be any naturally occurring amino acid
  misc_feature (65)..(65): Xaa can be any naturally occurring amino acid
  unsure (1)..(124): unsure at all Xaa locations
MGKRDXKPNRRRHXGEFSNDGEDFYDQHPPASPSIVDEDEENSEEEEEESDELQSSSDLPSKFLXYQQSVQSPKGDISYLQKFFLMYVGGRQPLHFQEDFCGTALLSAEWLKADTRRTAVGLDF

SEQ ID NO: 19266 - protein, 173 aa, Oryza sativa (japonica cultivar-group)
MLEGGNFSNQETLYEVLSVRKDATYDEIRAAYKSAVLNTHPDKAQMALNPLVSSSERNEFLSVQKAWEILRYPKSRAEYDKQLQSSRQNLEIVATEIEIDDMIVESTADSVELLYPCRCGDYFSITSRELGQIGISVREDGEMELHTSDSVPSSVVLGCGSCSLKARLVTNKT

SEQ ID NO: 19267 - protein, 112 aa, Pseudotsuga menziesii var. menziesii
DVPEDIFHQSMGSFLQQAEEEISQIQVEEVKVFSHVKEITKYFHGNAVKEEAHPFRIFVVVRDFTSMLDRVCKEVGRLQKSRNPPISSQKGPSSTSDDKLSRSLFPTDFDRN

SEQ ID NO: 19268 - protein, 141 aa, Glycine max
  misc_feature (24)..(24): Xaa can be any naturally occurring amino acid
  misc_feature (44)..(44): Xaa can be any naturally occurring amino acid
  misc_feature (68)..(68): Xaa can be any naturally occurring amino acid
  unsure (1)..(141): unsure at all Xaa locations
QTSSRTKPKGVQKGLMAKIITKFXKEGFYLKRVKPRTGDPPFGXKHQGYFFSKPFLKGLGEYLCPGPXVVARTGKGKKVVPPGQKIIEPPTPPQPNPETIRGTLPMTMERKVTHERNPLKRATKKMAWGSPKAPATCQTPH

SEQ ID NO: 19269 - protein, 488 aa, Arabidopsis thaliana
MKGVLLDESVLFSPESEDSSPSLRESVPSLLRLLRYSMIRTGISYGLDLPENKVDLLRKTAAEYSINCLPLETSLTSVTFGDTLKAWYSDGSILYVASSRKEEILRELSPSQLVVLLDVEGDSLEDPNIIHIHSLEELPMTICCINKKAMGDGAAIVAYIMKPSRVEDFAKRGALPMYPTSCGLIFLPLMFEFPLASQLKHADIIFHKATDEILSIELNCSDSKSSVAVTFSTGMEKLKKYMEDQNACAIVDPIRNIYPVVDRLKMQHILLGLEGLGAAGRKIRGACFLKIDSYDEPDLAQNLSRAGLSLPCIVKPQVACGVADAHSMAIVFRVEDFKNLNTPVPAIIQEYVDHSSRIFKFYVLGETIFHAVKKSIPSSSSLRKSAEENGLKPILFDSLKSLPVDSANQNPVSEIDLELVTEAATWLRKKLDLTIFGFDVVIQEGTGDHVIVDLNYLPSFKEVPDNIAVPAFWEAIRNRFDQHVQEKH

SEQ ID NO: 19270 - protein, 150 aa, Prosthecochloris aestuarii DSM 271
MIKILKILCPVDFSDASKKSIRYAHEFARGMGASLYLLNVVEPRPMAVDMSLSYVPLEEDLEKAAREDLELIVAAEREKGIVVEADVEIGTPSEIILEKAAELDVNLIILGSHGKTGLSRLLMGSVAESVVRKAQCPVLIVKAEETDFIE

SEQ ID NO: 19271 - protein, 135 aa, Zea mays
  misc_feature (16)..(16): Xaa can be any naturally occurring amino acid
  misc_feature (63)..(63): Xaa can be any naturally occurring amino acid
  misc_feature (74)..(74): Xaa can be any naturally occurring amino acid
  unsure (1)..(135): unsure at all Xaa locations
MLAYCGIYPDEVINNXAPHIGTPDKGILAANVSTDTIDKSLSTITAHNVEENRRALRELLFCXPGALQYISVCXILFQHTLYQNTRDGTPFVDVLKEGGDLPDIKVDKGTIVVVDTDKETTTQGHDDLDKRCAKD

SEQ ID NO: 19272 - protein, 346 aa, Zea mays
MASGGGGGLGAAGAGGRMPTWRERENNKRRERRRRAIAAKIFAGLRAHGGYKLPKHCDNNEVLKALCNEAGWVVEPDGTTYRQGSKPMERMDPIGCSVSPSPCSSYQPSPRASYNASPTSSSFPSGASSPFLPPNEMPNGIDGNPILPWLKTFSNGTPSKKHPLLPPLLIHGGSISAPVTPPLSSPSARTPRMKTDWDEAAVQPPWHGASSPTIVNSTPPSPGRPIAPDPAWLAGIQISSTSPNSPTFSLVSTNPFGVFKESIPVGGGGDSSMRMCTPGQSGACSPAIPGMPRHSDVHMMDVVSDEFAFGSSTNGAQQAAGLVRAWEGERIHEDSGSDDLELTLKL

SEQ ID NO: 19273 - protein, 394 aa, Zea mays
  misc_feature (222)..(222): Xaa can be any naturally occurring amino acid
  unsure (1)..(394): unsure at all Xaa locations
LGAARRARLPPGEMGWPLVGGMWAFLRAFKSDKPDAFIASFVRRFGRTGVYRSFIFSSPTVLLTTPEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPSFAYRGALRARRRLVAVLQGVLDERRXARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19274 - protein, 399 aa, Sulfolobus solfataricus P2
MKKVYDEIHAYIELDDREAKIIDMPEFQRLRRIKQTSLAYLVYPGATHTRFSHSLGTFYLTTILGEKFRQLGIITDEESTYLKLSALLHDIGQFPFSHSLEPLYLEKGLSNKDLRYMIISKSPNFREFFDNESIDYSKIIEILNGNSMMSSIVNSDVDVDRMDYLVRDSRHTGVQLGNIDLYRLLDTIFYGNNNEIVVQDKGIYSLENFFISRLHMYQAVYYHKTIIGYELMLREIFRTIYDCCDSSILSVENIRGLVYDSSISYWDDEWVFMILYTYLYSSNSPLYLKQKIRNFLDRRGPKVVYEEISYDNEMKGGDIKIKEIVDRLERNQIPRSSIYPIEEKIKILNKDKINIISKNNEMNIIRYKSTLINHIPETLTIRRIYVDHEYAKKARDVVP

SEQ ID NO: 19275 - protein, 394 aa, Zea mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGISGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19276 - protein, 394 aa, Zea mays
  misc_feature (1)..(1): Xaa can be any naturally occurring amino acid
  misc_feature (3)..(3): Xaa can be any naturally occurring amino acid
  misc_feature (12)..(12): Xaa can be any naturally occurring amino acid
  unsure (1)..(394): unsure at all Xaa locations
XGXARRARLPPXEMGWPLVGGMWDFLRAYKSGMPDTFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19277 - protein, 470 aa, Chlorobium tepidum TLS
MIAEPFLFRSEGGFIRIPIWGHIPLSAPLKKILAHPSFLRLKGIRQLSFAQQVYPGANHTRFEHSIGVYHLMKMILQRMVSNPLALELQDERLQFDDETCRTLLATCLLHDIGHYPHAHVLEEITPAGDSSAVFAHHESLTGQFLNEEHRDTPSIAAILHDDWQVNPDTVTEIIAGKTAHRLGKLVSGTLDPDKMDYLMRDAHHCNIPYGSIDIERLIESFVPDPERQRLAITEKGIAPLESLLFAKYMMMRNVYWHHTSRTFSTMLRRLLQDVADESALPMETLRELFYFNSDDRVLFELERAIRGLGLPAAELLDAILERRVYKRAMTIRPYHEPSMEIDPVWFAYNTSHRRRKEKELEICAMLAGKTGKRLAGHEVLIDAPPSKDVFDYSDFRELRIWPTKSEHRHLVQPTDSNGYVRFDDFRESVFGSDFILSFEQYTKKFRLLCRHDLVDTLSGLEEAVVEILRR

SEQ ID NO: 19278 - protein, 478 aa, Mycoplasma hyopneumoniae 232
MNDMKNYISKRTKIIATIGPSTQDYEVLKKLVLSGVSVIRANFSHGNYQEQKQKFDSARKLSNELKIPISIMLDTKGPEIRIGKILEGSQKILANQRLTVLTDSDSYQNFQGTAQIITVSHQIDKDLKIGDKILFDDGKLQSVVIEIEPGKVVVRTKNSHVLKSNKRLNLPGVAFSLPFLSQKDIDDILFGINENVNYIAASFVNSGENVRELRTLLDQNGGGHIQIISKIESRLGLENIDEIIELSDGIMIARGDLGLEVPYEEVPFQQKRIIRKCRFAGKTVVVATQMLDSMEKSSQPTRAEVTDVYWATELGADATMLSGESAQGQFPIESVQVMAVINKRAEKEFYNKLFYAKQLAVITENSRGLRAKIAHKLAHLAYEKEIKYTVVLSRTGQLLREIAKFRPNTAVIGVINNEKLINGFGITSSVFVSINSISEFTAIKNDFSLARNVLEPFGVEKGDTFLVVENEKMVQFVY

SEQ ID NO: 19279 - protein, 394 aa, Zea mays
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19280 - protein, 228 aa, uncultured cyanobacterium
HEVAGAGQHELGMKFAELIQAADNVMTYKYVVRNVAKKYGKTATFMPKPVFNDNGTGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELPAEELSKIATVPASLNGALEALNADRGFLTAGGVFSD

SEQ ID NO: 19281 - protein, 391 aa, Chaetosphaeridium globosum
MLTKKTDPMIVSMGPHHPSMHGVLRLVVSLDGENVIDCDPVLGYLHRGMEKIAENRSIVQYLPYVTRWDYLATMFTEAITVNAPEKLANIQVPKRASYIRVIMLELSRIASHLLWLGPFMADIGAQTPFFYIFREREMVYDLFESATGMRMMHNYFRIGGVAVDLPYGWLDKCLDFCDYFLPKIAEYENLITNNPIFRKRVEGIGIISREDAINWGLSGAMLRGSGVQWDLRKVDHYECYDELDWSIQWQSDGDCLARYLVRMGEMRESIKIIQQALKAIPGGPYENLEARRLNEGPKSEWNDFEYQFISKKSSPTFKLPKNEHYVRVEAPKGELGIYLIGDDTVFPWRCKIRPPGFVNLQILPQLVKGMKLADIMTILGSIDIIMGEVDR

SEQ ID NO: 19282 - protein, 228 aa, uncultured cyanobacterium
HEVAGAGQHELGMKFAELIQAADNVMTYKYVVRNVAKKYGKTATFMPKPVFNDNGTGMHVHQSLWKGGQPLFFGEGTYANLSQTARWYIGGILKHAPAFLAFTNPTTNSYKRLVPGFEVPVNLVYSEGNRSAAVRIPLTGPSPKAKRLEFRSGDALANPYLAFSAMMMAGLDGIKNQIDPGDGEDRDLFELPSEELSKIATVPASLNGALEALNTDRGFLTAGGVFSD

SEQ ID NO: 19283 - protein, 346 aa, Ricinus communis
MSKAGALDLASGVGGKIDKNEVLSAVEKYEKYHVYYGGAEEERKANYTDMVNKYYDLVTSFYEFGWGESFHFAHRFKGESLRESIKRHEHFLALQLGLKPEQKVLDVGCGIGGPLREISRFSLTSVTGLNNNEYQITRGKVLNRIAGVDKTCDFVKADFMKMPFPANSFDAVYAIEATCHAPDAYGCYSEIYRVLKPGQFFAAYEWCMTDSFDPNNQEHQKIKAEIEIGDGLPDIRLTGQCIEALKKAGFDVIWSGDLTASSPVPWYLPLDKNQYSLTGFRLTAIGRFFTRNMIKALEFAGLAPKGSQRVQDFLEKAAEGLVEGGRKEIFTPMFFFLAQKPHSENQ

SEQ ID NO: 19284 - protein, 509 aa, Rhodococcus sp. RHA1
MRDTRSKETMTYETMKPDAALAKVPTDLFIGGRWVSPGTGQTLAVENPATGDVIAEIADGGLADMAAALDAAAAAQRDWARTAPRTRSDILRRAYTLMLERSDYLATLTTLEMGKPYAQAQAEVTYAAEYLRWYSEEAVRIGGRYTVTESGVGRIVTMAQPVGPCLFVTPWNFPLAMGTRKIGPALAAGCTCIVKPAKQTPLSMLATASILEEAGVPAGVVNIVPSSDSTRVVAAAMNDPRLRKISFTGSTEVGQSLVRQSADQLLRVSLELGGNAPFIVFDDADVGSAVDAAVQAKLRNNGEACTSANRLYVHSSIAGDFAAELAERFSALTIGPGMDPGTDIGPLIDDKQRRQVQRLVDDAVAKGARVVTGGNPLDRPGCFFAPTVLTEVPGDALLMQEEIFGPVAPIISFDDEPAVLESANSSRYGLAAYVFTRDLDRAIRVAEQLDSGMVAINQGTVSNPAAPFGGVKHSGYGREGGPEGLAEYLETKYVALGAGTAPTSTGGMA

SEQ ID NO: 19285 - protein, 228 aa, uncultured cyanobacterium
HEVAGAGQHELGMKFAELIQAADNVMTYKYVVRNVAKKYGKTATFMPRPVFNDNGTGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELPAEELSKIATVPASLNGALEALNADRGFLTAAAFSAT

SEQ ID NO: 19286 - protein, 480 aa, Salmonella enterica subsp. salamae
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAARQHTDSDPLMLVLAADHAIANEEAFRDAVRSAMPYADAGKLVTFGIVPDLPETGYGYIRRGDVVPGATDVVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 19287 - protein, 113 aa, Synechococcus sp. CC9605
MRVERPWGWYETLTQGDNYLVKRLLVHAGQQLSLQRHRHRSESWTVVSGSGALLCGETWHAASAGVMLSIPCGAVHRARADSSDLLILEVQHGDDLREDDIERLQDDYGRVIT

SEQ ID NO: 19288 - protein, 228 aa, uncultured cyanobacterium
HEVADAGQHELGMKFAQLIEAADNVMTYKYVVRNVAKKYGKTATFMPKPVFNDNGTGMHVHQSLWKGGQPLFFGEGTYANLSQTARWYIGGILNHAPAFLAFTNPTTNSYKRLVPGFEAPVNLVYSEGNRSAAVRIPLTGPSPKAKRLEFRSGDALANPYLAFSAMLMAGLDGIKNQIDPGDGEDRDLFELAAEELSKIATVPASLNGALEALNADRAFLTAGGVFTD

SEQ ID NO: 19289 - protein, 574 aa, Arabidopsis thaliana
  misc_feature (480)..(480): Xaa can be any naturally occurring amino acid
  unsure (1)..(574): unsure at all Xaa locations
MNHSTSDQSLYIESDDGDDERKHLSDDEDDDGTLSDTSDAYNQNQHHLSKASPYSTAWPKSYRQSIDMFGSVPSPNLGFLANSSMSRRGSSFMSSTLTRRHTPESLPCVTKPLLEDEEAPKHKLSTHSLLPSKPSSSMVVSHDMGISNDSSFGQAVLNGVNVLCGVGILSTPYAVKEGGWLGLIILFAFGILCFYTGLLLRYCLDSHPDVQTYPDIGHAAFGSTGRILVSVILYMELYAMSVEYIILEGDNLSSMFPNASLSIGGFHLDAPRLFALLTTLAVLPTVWLRDLSVLSYISAGGVIASVLVVLCLFWVGLVDDVGIHSKGTPLNLATLPVSVGLYGYCYSGHGVFPNIYTSMAKPSQFSAVLLASFGICTLMYAGVAVMGYSMFGESTESQFTLNLPQDLVASKIALWTTKESTYALTLSPVAMSLEELIPSNYGKSRFYAIAIRSALAISTLLVGLAIPFFGLVMSLIGSFXDNAHYADTTASLFLEHLKEKSNPYSDLVSQTLQVKTIMKSCLGFIFNWDLYFTIISSEGVAGEGTLADSVAEFDELQTLVTEASFASRITDNCL

SEQ ID NO: 19290 - protein, 736 aa, Arabidopsis thaliana
  misc_feature (117)..(117): Xaa can be any naturally occurring amino acid
  unsure (1)..(736): unsure at all Xaa locations
MKVQEGLFLVAIFFSLACTQLVKGQHQPGENCQNKCGNITIEYPFGISSGCYYPGNESFSITCKEDRPHVLSDIEVANFNHSGQLQVLLNRSSTCYDEQGKKTEEDSSFTLENLSLXSANNKLTAVGCNALSLLDTFGMQNYSTACLSLCDSPPEADGECNGRGCCRVDVSAPLDSYTFETTSGRIKHMTSFHDFSPCTYAFLVEDDKFNFSSTEDLLNLRNVMRFPVLLDWSVGNQTCEQVGSTSICGGNSTCLDSTPRNGYICRCNEGFDGNPYLSAGCQDVNECTTSSTIHRHNCSDPKTCRNKVGGFYCKCQSGYRLDTTTMSCKRKEFAWTTILLVTTIGFLVILLGVACIQQRMKHLKDTKLREQFFEQNGGGMLTQRLSGAGPSNVDVKIFTEDGMKKATNGYAESRILGQGGQGTVYKGILPDNSIVAIKKARLGDSSQVEQFINEVLVLSQINHRNVVKLLGCCLETEVPLLVYEFITNGTLFDHLHGSMIDSSLTWEHRLKIAIEVAGTLAYLHSSASIPIIHRDIKTANILLDVNLTAKVADFGASRLIPMDKEELETMVQGTLGYLDPEYYNTGLLNEKSDVYSFGVVLMELLSGQKALCFKRPQSSKHLVSYFATATKENRLDEIIGGEVMNEDNLKEIQEAARIAAECTRLMGEERPRMKEVAAKLEALRVEKTKHKWSDQYPEENEHLIGGHILSAQGETSSSIGYDSIKNVAILDIETGR

SEQ ID NO: 19291 - protein, 480 aa, Salmonella enterica subsp. salamae
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAARQHTDSDPLMLVLAADHAIANEEAFRDAVRSAMPYADAGKLVTFGIVPDLPETGYGYIRRGDAVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 19292 - protein, 228 aa, uncultured cyanobacterium
HEVAGAGQHQLGMKFAQLIEAADNVMIYKYVVRNVAKKYGKTATFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKIATVPPSLNGALEGLSANRAFLTEGGVFTD

SEQ ID NO: 19293 - protein, 625 aa, Oryza sativa
MQRSRRALLKRKAAAAAKEEEEEAGVGVATAAAAGRRRRRRLYGFSVSLVVACWVVLLLLNPLVGHGNGQRDEGIFADEGSSDPSFDSVEPTLSEGSVDSVVQQENGENHALPGDSCAKPDENHVLSEETLLEKDQLCSNDEAQGDSMDALPKDNVDQGENLPRTDDDSVVHPEGEVESEGVPRPARLSRVVPPGLDEFKTRAIAERGKGVPSGQPGNVIHRREPSGKLYNYASAAKGAKVLEFNKEAKGASNILDKDKDKYLRNPCSAEGKFVIIELSEETLVDTIAIANFEHYSSNLKEFEMLSSLNYPTDSWETLGRFTVANAKIAQNFTFPEPKWARYLKLNLLSHYGSEFYCTLSMLEVYGMDAVEKMLENLIPVENKRLEPDDKMKEPVDQQTQLKEPTEGKESSHEPLDEDEFELEDDKLNGDSSKNGAHDQVTETRPIQAGRIPGDTVLKVLMQKVQSLDVSFSVLERYLEELNSRYGQIFKDFDADIDTKDALLEKIKLELKHLERSKDDFAKEIEGILSWKLVASSQLNQLLLDNVIIRSELERFREKQADLENRSFAVIFLSFVFGCLAIAKLSIGMIFNTCRLYNFEKFDRVKSGWLVLLFSSCIIASILIIQ

SEQ ID NO: 19294 - protein, 274 aa, Vibrio angustum S14
MSSDQVHLGHRARKRFGQNFLKDPYIIDGIVSSINPLPGQNLVEIGPGLGAITEQVGKLVDKFTVIELDRDLAERLENHPDLASKLTIHQGDAMRFDFTQLIKENNKLRIFGNLPYNISTPLMFHIFEFHKDVEDMHFMLQKEVVNRLAAGPGSKAYGRLTVMAQYYCRVMPVLEVPPESFVPAPKVDSAVVRLTPYETLPYPCTSLKWLDRVCREGFNQRRKTIRNCYKALFTAEQLEALGVNPGNRPENITVEQFVAMANWLDANYQKDAKA

SEQ ID NO: 19295 - protein, 480 aa, Salmonella enterica subsp. indica
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRSAMPYADAGKLVTFGIVPDLPETGYGYIRRGDAVPGATDAVAFEVAQFVEKPGLETAQAYVASGDYYWNSGMFLFRAGRYLEELKKFRPDILAACEQAMRGVDPDLDFIRVDEEAFLSCPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLIGENESIYIPLGATHCLENPGKIPLDLIEVRSGSYLEEDDVVRFEDRYGRV

SEQ ID NO: 19296 - protein, 325 aa, Aspergillus oryzae
MSNGKTFTLSNGVKIPGVGFGTFASEGSKGETYQAVTKALETGYRHLDCAWFYLNEDEVGDGIHDFLKKNPSVKREDIFVCTKVWNHLHRPEDVQWSVDNSLKRLRLDYVDLFLVHWPIASEKEDQEKPKIGPDGKYVILKELTENPEPTWRAMEKIYRDGKAKAIGVSNWTIPGLEKLFKFAEIKPHVNQIEIHPFLPNNELVQFCFKNDILPEAYSPLGSQNQVPTTGERVSENKTLNEIAQKGGNTLAQVLIAWGLRRGYVVLPKSSNPARIESNFKSIELTDEDFEAVNKVAEGRHFRFVNMKDTFGYDVWPEETAKNLSA

SEQ ID NO: 19297 - protein, 202 aa, Triticum aestivum
  misc_feature (186)..(187): Xaa can be any naturally occurring amino acid
  misc_feature (197)..(197): Xaa can be any naturally occurring amino acid
  unsure (1)..(202): unsure at all Xaa locations
LHKINSPSGRGNAEELDTSERQAFLEWRRNLARLEENDKLVLTPFEKNIDIWRQLWRVIERSDLLVMVVDARDPLFYRCPDLEVYAKELDEHKRTMLLVNKADLLPLNIRKIWADYFKEHDILHVFWSAKAATATLEGKMSSGEQGSASPDMDTKISGREELLMRLQAEAKSIAAQRRTSASKGEXXSSTDSVSSVXKHVVA

SEQ ID NO: 19298 - protein, 139 aa, Methanococcus maripaludis S2
MACENELERTFVALKPDTVERKLVGRVIQRFEDRGFEIVEMRMLTLTMEMAEEYYGEHKGKEFYERLIKFMTSGRIVAMVIKGERAISTVRKMLGNTCPCDAEPGTIRGDFGLYTPANIIHASDSLESAEREIDLFFGR

SEQ ID NO: 19299 - protein, 492 aa, Gluconacetobacter xylinus
MTFMTATDVTVPNPETALPPITPIVLSGGTGTRLWPVSRASHPKQFWALASKQTMIGETLQRAMGEAFAPPIVVCNQAHRFLVAEQLRENGCENGRIILEPAVRNTAAAIAAAALVAAQDNPETLLWIMAADAAFRYPERLPAVLEKAAKVAREGYIVTFGMKPDVAETGYGYIRTGAPLHPDQPDEGVYRVTQFIEKPDHLRATEMLREGGYLWNSGMFMAPASVMLDELARHEPEVLENVRTALARSQHDLTFRRLEAESFLRCPNVSIDYAVMERTDRAMVIPADLGWSDVGNWNALWELGDKDAGGNVVVGDVVLEQSHNCYVRSEGMLTAVAGLTDIVLVVTTDAVLAIHRDYAQDVSALVAQLKKASRTEAEIHNRCYRPWGFYEGLIQGERFQVKRIVVYPGQKLSLQKHFHRAEHWVVVSGTALVTRDDENLLIQENESVYLPLGCMHRLENPGRIPLTLIEVQSGPYLGEDDIVRFEDTYGRQ

SEQ ID NO: 19300 - protein, 394 aa, Aspergillus oryzae
MSGFFTYRQFSLYDTPSLANQVAVVTVSVKTSPTYNSLGPLGSGREAASNSLFQYLLHPLTRVANVNLEITAQLLLHGIETVYVLARSHDKYIRAQEEWQRRIGGSLGKGDTRVQFIQCDLADIVAAKSAANELKHKTDRLDIMICNAATIYNRPFVDVPTPAKAIGVSTNYERSPQGIEQVFASNCVGHQVLATNLLPLMKRTINQGKASNGRIAVASSSMHVFCRELNLDLLTSPTRLKPAYIDGVWRYARAKVGNILFARELSLRLMQEEDPASSKIYVNAFFPGNIVTDQWSVWDEYIGEALGSLFRLLFSIIGQSLEDGAANAIYLAASPKVISNSTRGQYFIPIAKPYKTTAIASDMKLARDLWDWTEAKAAEALGPEEQAKTRTVDG

SEQ ID NO: 19301 - protein, 360 aa, Cicer arietinum
LERHELVPTVWNEYGWDKVSNILYVDQPTGTGFSYSSDLRDIRHNEKGVSNDLYDFLQAFFAEHPQYAKNNFFITGESYAGHYIPALASRIRQGNQAKEGIHINLKGLAIGNGLTNPAIQYKAYADYALDMGIITKATHDRLGLVLVPACELAIKLCGTDGKLACLTANVACNLIFSDILLHAGDVNYYDIRKKCEGSLCYDFSNMEKFLNQESVRDSLGVAKISFVSCSTEVYIAMLVDWMRNLEVGIPILLEDGINLLVYAGEYDLICNWLGNSRWVHAMEWSGQKKFVASPDVPFVVNGSEAGLLKNYGPLSFLKVYDAGHMVPMDQPKAALEMLKKWTRGTLAESKVGEEEFVADM

SEQ ID NO: 19302 - protein, 444 aa, uncultured archaeon GZfos31B6
MILMTANEDVLGMIAENNIKFIRLQFVDVLGIVKNVAIPAAQMKKALDVGISFDGSSIEGFARIQESDMVLKPDPETFRILPWKADEGKIAGIVCDVCLPDGTPFHGCPRYALTRAITEAEKMGYVMNTGPELEFFLFEKEDGIPTTTPHDSGGYFDFPPVDLAEDIRRDIVIALEEMDFEIEASHHEVACGQHEIDFKYSDALTTADKVVTFKYVTKTIATNKNLHATFMPKPVFGTSGSGMHINTSLFNKNNENVFFSPDDDHGISDTARYFIGGLLAHIKAVTAITNPLVNSYKRLVSGYEAPVYITWSWANRSSLIRVPAARGSGTRIELRSPDPSCNPYLAFAAILASGLDGVKNKIDPGEPIEENIYEMDFHEITDAGIDTLPTSLSLALDYLESDAVVRSALGEHVYTAFMRVAAAEWEEYRVQVHQWELDRYLQLF

SEQ ID NO: 19303 - protein, 399 aa, Bordetella pertussis
MAQIVLFENIHPSARAVFSAAGYTDIVAHAAALPSGELREALRGAEVVGIRSRTHLDADLLAANPDLRVVGCFCIGTNQVDLDAAMMRGVPVFNAPFSNTRSVAELVLGETILLLRRIPEKNARVHLGHWDKSAAGAYEARGKTLGIVGYGNIGSQISTLAEAIGMRVVFFDVEAKLPLGNARAAGSLAELLEQADVVTLHVPGGKSTQNIVNADTLARMKRGAILINASRGTVVDIQALHDALASGHLAGAALDVFPTEPKSADEPLASPLIGMPNVVLTPHIGGSTQESQENIGREVAEKLVRFLQAGTTKSAVNFPELSYQAPVGGSRIIHVHRNAPGALGALDNLMAQHGLNIVSQSLQTKGQIGYAVTDVDGEVSDTVLADLRSHPVTVRCEKL

SEQ ID NO: 19304 - protein, 398 aa, Ehrlichia canis str. Jake
MSLIAGRMDCIKPSPTLEIASQAQKLKMSGVDVISLSAGEPDFDTPQHVKQAAIDAINAGKTKYTAVDGIIELKKAIVDRFKQDHDLTYDVNQVSVGNGAKQCIYNLLMATINDGDEVIIPAPYWVSYPDVVKISGGNPVIVDCSETFKLTPDLLESVITEKTKWLIINSPNNPTGLMYTYEELQCIAEVLLKYPNIYIMTDDIYSKIVYDGFKFFTIAQVEPRLYDRVFTVNGVSKAYAMTGWRIGYVAGDSKVISAISVIQSQSTTNPNSIAQFASVHALTGDQEFLKERNKIFAERRDMMMNMVNNTSVLSVKKPQGAFYVFISCKELIGKSAKNGLVINSGIDFTRYLLEDYNVAAVPGEAFGVQGFFRISYATSTEQLSKACDRILDACNKLL

SEQ ID NO: 19305 - protein, 394 aa, Zea mays
LGAERRARLPPGEMGWPLVGGMWDFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRPMAINLPGIAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 19306 - protein, 478 aa, Burkholderia sp. 383
MQRATKIVATIGPASSSPEILLQMMQAGLDVVRLNFSHGTADDHRQRAEMVREAARKVGREIAIMADLQGPKIRVGKFENGKTTLEPGQAFILDAGCELGNDERVGLDYKELPRDLRTGDLLLLNDGLIVLTVERVLGDEIHTIVKVGGELSNNKGINRQGGGLSAPALTAKDMEDIRTAMSLGADLVAVSFPKNATDMEMARQLANIAGAPYGIKPKMIAKIERAEAIPALQSILDASDGIMVARGDLAVEVGNAAVPALQKRMIRMARESNKLVITATQMMESMIHAPVPTRAEVSDVANAVLDGTDAVMLSAETAAGKYPVVTIETMAAVCVEAEKSEHVELDKDFLDRTFTRIDQSIAMGALFTAYHLGAKAIIALTESGATALWMSRHYTHVPIFALTPRVGSERTMALYRNVTPLHVDFNSDRDSALQAALEIVVKQGYVQHGDMVVLTVGEPMGQAGGTNTLKIVRVGEHY

SEQ ID NO: 19307 - protein, 394 aa, Zea mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 19308 - protein, 472 aa, Mycobacterium tuberculosis CDC1551
MTRRGKIVCTLGPATQRDDLVRALVEAGMDVARMNFSHGDYDDHKVAYERVRVASDATGRAVGVLADLQGPKIRLGRFASGATHWAEGETVRITVGACEGSHDRVSTTYKRLAQDAVAGDRVLVDDGKVALVVDAVEGDDVVCTVVEGGPVSDNKGISLPGMNVTAPALSEKDIEDLTFALNLGVDMVALSFVRSPADVELVHEVMDRIGRRVPVIAKLEKPEAIDNLEAIVLAFDAVMVARGDLGVELPLEEVPLVQKRAIQMARENAKPVIVATQMLDSMIENSRPTRAEASDVANAVLDGADALMLSGETSVGKYPLAAVRTMSRIICAVEENSTAAPPLTHIPRTKRGVISYAARDIGERLDAKALVAFTQSGDTVRRLARLHTPLPLLAFTAWPEVRSQLAMTWGTETFIVPKMQSTDGMIRQVDKSLLELARYKRGDLVVIVAGAPPGTVGSTNLIHVHRIGEDDV

SEQ ID NO: 19309 - protein, 443 aa, Arabidopsis thaliana
MQRSRRALLVRRRVSETTSNGRNRFYKVSLSLVFLIWGLVFLSTLWISHVDGDKGRSLVDSVEKGEPDDERADETAESVDATSLESTSVHSNPGLSSDVDIAAAGESKGSETILKQLEVDNTIVIVGNVTESKDNVPMKQSEINNNTVPGNDTETTGSKLDQLSRAVPLGLDEFKSRASNSRDKSLSGQVTGVIHRMEPGGKEYNYAAASKGAKVLSSNKEAKGASSIICRDKDKYLRNPCSTEGKFVVIELSEETLVNTIKIANFEHYSSNLKDFEILGTLVYPTDTWVHLGNFTALNMKHEQNFTFADPKWVRYLKLNLLSHYGSEFYCTLSLLEVYGVDAVERMLEDLISIQDKNILKLQEGDTENEKEKVKERLEQVLERLEWMEKKGVVVFTICVGFGTIAVVAVVFGMGIVRAEKQGGLAWLLLLISSTFVMFILSL

SEQ ID NO: 19310 - protein, 228 aa, uncultured cyanobacterium
HEVAGAGQHELGMKFAELIQAADNVMTYKYIVRNVAKKYGKTATFMPKPVLNDNGSGMHVHQSLWKGGQPLFFGEGTYANLSQTTRWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGDGVDVDLFELAADELKKIATVPASLNGALEALNSDHHYLLEGGVFTK

SEQ ID NO: 19311 - protein, 172 aa, Brassica napus
  misc_feature (130)..(130): Xaa can be any naturally occurring amino acid
  misc_feature (137)..(137): Xaa can be any naturally occurring amino acid
  misc_feature (142)..(142): Xaa can be any naturally occurring amino acid
  unsure (1)..(172): unsure at all Xaa locations
MDLASNLGGKIGKSDVLTAVEKYEQYHEFHGGDEEERKANYTDMVNKYYDLATSFYEYGWGESFHFAHRWNGESLRESIKRHEHFLALQLGVKPGQKVLDVGCGIGGPLREIARFSNSSVTGINNNEYSXQISILGXTRRLXSPGFDKTCNFVKADFMKMPFPENTFDAVYA

SEQ ID NO: 19312 - protein, 470 aa, Bordetella bronchiseptica RB50
MASPKDVLKQIADNEVKFVDFRFTDTLGREHHVSVPTSAVDEDKLESGQAFDGSSIPGWKGIEASDMLLIPDLDTANLDPFREEPTLILSCDVVEPSDLKGYDRDPRSLAKRAEAYLKSSGLGDTAYFGPEPEFFVFDGVTWNTDMSGTFVKIKSEEAPWSSGLEFEGGNMGHRPGPKGGYFPVPPVDSFQDMRSEMCLLLEQMGVPVEVHHHEVAAPGQLEIGTKFSTLVQRADWNQVMKYVIHNVAHVYGKTATFMPKPIVGDNGSGMHVHQSIWKDGQNLFAGNGYAGLSEFALYYIGGIIKHARALNAITNPGTNSYKRLVPHFEAPVKLAYSARNRSASIRIPYVGNPKARRIETRFPDPLANPYLAFSALMMAGLDGVQNKIHPGDPADKNLYDLPPEEDAKIPTVCASLEEALAALDKDREFLTRGGVFSNDMLDAYIELKMGEVTRLRMTTHPVEFDMYYSL

SEQ ID NO: 19313 - protein, 150 aa, Arabidopsis thaliana
  misc_feature (31)..(31): Xaa can be any naturally occurring amino acid
  misc_feature (54)..(54): Xaa can be any naturally occurring amino acid
  unsure (1)..(150): unsure at all Xaa locations
YDCPLLCSQLQVMSRGTGATKEQGAIGTMLXGAMGKILIADDKMLDPVTGLSGXSGPAYIFLALEALDDEGVAAGLRLQLALSLASQTDLEAALMVSKTGKHPGVLKDDVASPGGCTIVVVHELEKGSLRTTLMNAVDVTANESRELSQR

SEQ ID NO: 19314 - protein, 172 aa, Triticum aestivum
  misc_feature (58)..(58): Xaa can be any naturally occurring amino acid
  misc_feature (72)..(72): Xaa can be any naturally occurring amino acid
  misc_feature (91)..(91): Xaa can be any naturally occurring amino acid
  misc_feature (95)..(96): Xaa can be any naturally occurring amino acid
  misc_feature (99)..(100): Xaa can be any naturally occurring amino acid
  misc_feature (113)..(113): Xaa can be any naturally occurring amino acid
  unsure (1)..(172): unsure at all Xaa locations
MAPTVMASSATSVAPFQGLKSTAGLPVSRRSNGASLGSVSNGGRIRCMQVWPIEGIKXFETLSYLPPLSTEXLLKQVDYLIRSKVVPFLRXQQVXXIFXXEHNASPGYYDGRXYWDMLELPKFPDAPTPPGDRRWRRSKKGYLTLFPHIDTNLSCSTFNHRLKIKLKIPHSI

SEQ ID NO: 19315 - protein, 421 aa, Arabidopsis thaliana
MVSYRATTETISLALEANSSEAITILYQVLEDPSSSPEAIRIKEQAITNLCDRLTEEKRGEDLRKLLTKLRPFFSLIPKAKTAKIVRRIIDAVAKIPGTTDLQITLCKEMVEWTRAEKRTFLRQRVEARLAALLMENKEYVEALALLSTLVKEVRRLDDKLLLVDIDLLESKLHFSLRNLPKAKAALTAARTAANAIYVPPAQQGTIDLQSGILHAEEKDYKTGYSYFFEAFESFNALGDPRAVFSLKYMLLCKIMVSQADDVAGNNLLKGWTTVGPDLDAMKAVADAHSKRSLKLFENALRDYKAQLEDDPIVHRHLSSLYDTLLEQNLCRLIEPFSRVEIAHIAELIGLPLDHVEKKLSQMILDKKFAGTLDQGAGCLIIFEDPKADAIYSATLETIANMGKVVDSLYVPVCQNHVPEK

SEQ ID NO: 19316 - protein, 474 aa, Trichodesmium erythraeum IMS101
MFSLMAESNFFSEIFLFPLSGKIAPILATATETGAEPEMVLAGVLLSLVAIYIASKAGGEFFSWLNFPPVLGELVGGVVIGISALHLVIFPESGADSSSSVIINILEATAGLAPEAAGATLQAQSEVLDVLAELGVIILLFEIGLESNIRDLMQVGVQSLIVATVGVVLPFVGGTAGMMAIFHVSAVPAVFAGAALTATSIGITSRVLTEINRLNTQEGQIILGAAVIDDVMGIIILAVVASLAKTGEVDIINVVYLIISASVFLVGAILLGRFFNDGFVFFAEKFKTRGRAVIPALTIALFMAYIGTAIHLEAILGAFAAGLVLDNLDQKEVGRELEELIRPISDVIVPIFFVTVGTKTNLNVLNPAIPTNREGLVIAIFLIAVAIVGKVACGFSVFGLGPINRLAIGVGMVPRGEVGLVFASVGSASGALSPALDVAIILMVILTTFLAPPLLRVVFGKAEAETEEVPETSG

SEQ ID NO: 19317 - protein, 488 aa, Magnaporthe grisea 70-15
MASLYRLAGRGASKRLCLRPATSSQIPISASCSSAASTIRSLSSTTRRRYATTPDPAELIKAQATRLVPVDSDFSNPVDPYFVTNRKDDIEANEPGVAERKIRHYTVNFGPQHPAAHGVLRLILELSGEEIVRADPHVGLLHRGTEKLCEYKTYLQALPYFDRLDYVSMMTNEQCFALAVEKLLNIEIPERAKYIRTMFGEITRVLNHLMSVLSHAMDVGALTPFLWGFEEREKLMEFYERVSGARLHAAYVRPGGVHQDIPAGLLDDIYQWATQFGDRIDETEEMLTDNRIWINRLQGVGVVSAKEALDLSFTGVMLRGSGVPWDIRKSSPYDAYDKVEFDIPVGLNGDCYDRYLCRMEEFRQSLRIIHQCLNQMPAGPVRVEDYKVSPPPRAAMKENMEALIHHFLLYTKGYAVPPGDTYSVIEAPKGEMGVYVVSDGSERPYRVHIRAPGFAHLAGFDHVCKGHLLADAVAVIGTMDLVFGEVDR

SEQ ID NO: 19318 - protein, 157 aa, Triticum aestivum
  misc_feature (101)..(101): Xaa can be any naturally occurring amino acid
  misc_feature (107)..(107): Xaa can be any naturally occurring amino acid
  unsure (1)..(157): unsure at all Xaa locations
MATTERTFIAVKPDGVQRGLIGHIISRFEARGFKLSGNQTSYLPIEQKLKEHYQDLSDKPFFSGLITYMGSGPICAMIWEGRDAVKTGRTILGATNPLASXPGTIRXGDYALDVGRNVCHGSDSVENAQKEISIWFSERERYNPGNPAQNDWVYEKP

SEQ ID NO: 19319 - protein, 388 aa, Pyrococcus horikoshii
ALSDRLELVSASEIRKLFDIAAGMKDVISLGIGEPDFDTPQHIKEYAKEALDKGLTHYGPNIGLLELREAIAEKLKKQNGIEADPKTEIMVLLGANQAFLMGLSAFLKDGEEVLIPTPAFVSYAPAVILAGGKPVEVPTYEEDEFRLNVDELKKYVTDKTRALIINSPCNPTGAVLTKKDLEEIADFVVEHDLIVISDEVYEHFIYDDARHYSIASLDGMFERTITVNGFSKTFAMTGWRLGFVAAPSWIIERMVKFQMYNATCPVTFIQYAAAKALKDERSWKAVEEMRKEYDRRRKLVWKRLNEMGLPTVKPKGAFYIFPRIRDTGLTSKKFSELMLKEARVAVVPGSAFGKAGEGYVRISYATAYEKLEEAMERMERVLKERKLV

SEQ ID NO: 19320 - protein, 247 aa, Saccharomyces cerevisiae
MPKLVLVRHGQSEWNEKNLFTGWVDVKLSAKGQQEAARAGELLKEKKVYPDVLYTSKLSRAIQTANIALEKADRLWIPVNRSWRLNERHYGDLQGKDKAETLKKFGEEKFNTYRRSFDVPPPPIDASSPFSQKGDERYKYVDPNVLPETESLALVIDRLLPYWQDVIAKDLLSGKTVMIAAHGNSLRGLVKHLEGISDADIAKLNIPTGIPLVFELDENLKPSKPSYYLDPEAAAAGAAAVANQGKK

SEQ ID NO: 19321 - protein, 112 aa, Brassica napus
MCAAEHQSEMQQSRARLFKEYKEVQREKVADPDIQLVCDETNIFKWTALIKGPSETPYEGGVFQLAFAVPENYPLQPPQVRFLTKIFHPNVHFKTGEICLDILKNAWSPAWT

SEQ ID NO: 19322 - protein, 430 aa, Triticum aestivum
  misc_feature (35)..(35): Xaa can be any naturally occurring amino acid
  misc_feature (327)..(327): Xaa can be any naturally occurring amino acid
  unsure (1)..(430): unsure at all Xaa locations
TSRSGRRAQAGKWQRAKYVGVSLVGKTLAIMGFGXVGSEVARRAKGLGMHVIAHDPYAPADKARAIGAELVSFEEAIAKADFISLHMPLTPATSKVFNDESFGKMKTGVRIINVARGGVIDEDALVRALDSGKVAQAALDVFTVEPPAKDSKLVLHENVTVTPHLGASTVEAQEGVAIEIAEAVGGALRGELAATAVNAPMVPAEVLSELAPYVSLAEKLGRLAVQLVAGESGIKGVKVVYTSARDPDDLDTRLLRAMVTKGIVEPVSSTFVNLVNADYTAKQRGLRIAEERVSHDNAAAEAPLESIQVRLSHVQSKFAGAISDGGXDIVVVGRVKYGVPHLTVVGPYEVDVSLEGNLILCRQIDQPGMIGKVGNILGQRNVNVSFMSVGRTSRGKQAIMAIGVDEEPDKKTLEKIGAIPAVEEFVFLEL

SEQ ID NO: 19323 - protein, 394 aa, Zea mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 19324 - protein, 678 aa, Arabidopsis thaliana
MSKKHLKPLETCFEDEEDDVIYLPPGLVTGATSKKNEEFCGGSGKVQPSEMKRRSEGTSTDMTSKRAKKVSAEDEKKVGEWTKNPYFQRLWSEEDEIVMLQGIIKFEDVTGKSPFEDRHGFIEFVKNSISFEASVQQYIGKISQLKRKYTRKRKNGFSEGHEQKCFKLAMSIWGTKETSKKTDLCSSPKGKKVKEEDGDVTNSDWFENSFLLPSIESLGVDSVKRKWNVVPMEFKKKIEERLELLEADESECKKMEEMLKVKNSECVKQKTNLLNELLQDAVPNICVSRLRFPAMALQATTTTFCFSGPTFRSTPHSLTSKRPISIKATTSSPSRLSNSRSNLKGRALSSDGSTQESPYVVCFGEMLIDFVPTTSGLSLADAPAFKKAPGGAPANVAVGIARLGGSSAFIGKVGEDEFGYMLANILKDNNVNNDGMRFDPGARTALAFVTLTNEGEREFMFYRNPSADMLLEESELDFDLIKKAKIFHYGSISLITEPCKSAHISAAKAAKEAGVILSYDPNLRLPLWPSADNAREEILSIWETADIIKISEEEIVFLTKGEDPYDDNVVRKLFHPKLKLLLVTEGPEGCRYYTKDFSGRVHGLKVDVVDTTGAGDAFVAGILSQLANDLSLLQDEERLREALMFANACGALTVKVRGAIPALPTKEAVHEALLKAVV

SEQ ID NO: 19325 - protein, 134 aa, Brassica napus
  misc_feature (112)..(112): Xaa can be any naturally occurring amino acid
  unsure (1)..(134): unsure at all Xaa locations
MRKLRGIKIRRPIQRISRWILRRIRLRRSRYIRLGPTQPVCKPKAITKLISWGRSLTSHSARFLGSKISNSGYAPIGNDPIQSKPDPVPKGHSAVYVGKKDGDFHRVLVPIXYFNHPLFGELLREAEEEFGFCQ

SEQ ID NO: 19326 - protein, 394 aa, Zea mays
  misc_feature (29)..(29): Xaa can be any naturally occurring amino acid
  misc_feature (36)..(36): Xaa can be any naturally occurring amino acid
  unsure (1)..(394): unsure at all Xaa locations
LGAERRARLPPGEMGWPLVGGMWDFLRAXKSGKPDXFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19327 - protein, 506 aa, Triticum aestivum
  misc_feature (147)..(147): Xaa can be any naturally occurring amino acid
  unsure (1)..(506): unsure at all Xaa locations
MAAIMASITSELLFFLPFILLALLTFYTSAVAKCHGLHRWSGRTKKRRPNLPPGAVGWPFIGETFGYLRAHPATSMGQFMDQHIARYGKIYRSSLFGDRTVVSADAGLNRYILQNEGRLFECSYPRSIGGILGKWSMLVLVGDPHRXEMRSISLNFLSSVRLRAGLLPEVERQTLLVLRDWLPSSSSAVFSAQHEAKKFTFNLMAKNIMSMDPGEEETERLRLEYITFMKGVVSAPLNFPGTAYWKALKSRATILGVIERKMEERLEKMNKEASSMEEDDLLGWAMKQSNLSKEQILDLLLSLLFAGHETSSMALALAIFFLEGCPKAVEELREEHLEIARRQKLRGECKLSWEDYKEMVFTQCVINETLRLGNVVRFLHRKVIRDVHYNGYDIPSGWKILPVLAAVHLDSSLYEDPSSFNPWRWKGNASGVAQNSNFMPYGGGTRLCAGSELAKLEMAIFLHHLVLNFRWELAEPDQAFVYPFVDFPKGLPIRVHRIAQEEEGEE

SEQ ID NO: 19328 - protein, 394 aa, Zea mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTSL

SEQ ID NO: 19329 - protein, 378 aa, Bacillus subtilis subsp. subtilis str. 168
MKAVTYQGIKNVVVKDVPDPKIEKSDDMIIKVTSTAICGSDLHLIHGFIPNMQEDYVTGHEPMGIVEEVGSGVTKLKKGDRVIIPFNIACGECFFCKNQLESQCDQSNDNGEMGAYFGYSGQTGGYPGGQAEYLRVPFANFTHFKIPESCEEPDEKLSVIADAMTTGFWSVDNAGVKKGDTVIVLGCGPVGLFAQKFCWLKGAKRVIAVDYVNYRLQHAKRTNKVEIVNFEDHENTGNYLKEITKGGADVVIDAVGMDGKMSDLEFLASGLKLHGGTMSALVIASQAVRKGGTIQITGVYGGRYNGFPLGDIMQRNVNIRSGQAPVIHYMPYMFELVSTGKIDPGDVVSHVLPLSEAKHGYDIFDSKMDDCIKVVLKP

SEQ ID NO: 19330 - protein, 394 aa, Zea mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFMKMEYLSQVIDETLRLVNISFVSFRQATRDVFVNGYLIPKGWKVQLWYRSVHMDPQVYPDPTKFDPSRWEGHSPRAGTFL

SEQ ID NO: 19331 - protein, 148 aa, Bacillus thuringiensis serovar konkukian str. 97-27
MEKTFLMVKPDGVQRAFIGEIVARFEKKGFQLVGAKLMQVTPEIAGQHYAEHTEKPFFGELVDFITSGPVFAMVWQGEGVVDTARNMMGKTRPHEAAPGTIRGDFGVTVAKNIIHGSDSLESAEREIGIFFKEEELVDYSKLMNEWIY

SEQ ID NO: 19332 - protein, 394 aa, Zea mays
LGAERRARLPPGEMGWPLVGGMWDFLRAYKSGKPDTFIDSFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 19333 - protein, 149 aa, Arabidopsis thaliana
  misc_feature (4)..(4): Xaa can be any naturally occurring amino acid
  misc_feature (16)..(16): Xaa can be any naturally occurring amino acid
  misc_feature (58)..(58): Xaa can be any naturally occurring amino acid
  misc_feature (112)..(112): Xaa can be any naturally occurring amino acid
  misc_feature (121)..(121): Xaa can be any naturally occurring amino acid
  misc_feature (124)..(124): Xaa can be any naturally occurring amino acid
  unsure (1)..(149): unsure at all Xaa locations
NNDXTSITSNGGRVNXMQVWPPIGKKKFETLSYLPDLTDSELAKEVDYLIRNKWIPCXEFELEHGFVYREHGNSPGYYDGRYWTMWKLPLFGCTDSAQVLKEVEECKKGVPXAFIRIIGFXNTXQSPVESSFNLPYKKVTGKFFFPKRS

SEQ ID NO: 19334 - protein, 680 aa, Oryza sativa (japonica cultivar-group)
MAPPPPSPPCRPRVKPERALLCFSLLLLLTATTANASITDCPTTSSTNSSHVDDGAFGANLRALLSSLSAAAAASSSGFAENATGAAPDTAYGLAQCRGGIVGGGNGTSCRSCLDDSVRDAAKACPGEKSAVIISDYCLVRYSNASFAGAADERTVKLWWNTDNATQPERFKSLLGTLMGNLTDAAARASSPLMFAAGETDLPPFTKIYGMAQCTRDLAAGDCYRCLVGAVNNIPKCCDGKQGGQVITRSCSIRFEVYPFFDAQAAKAAMSPAPAPAPVTTPTGVNGSNHTVSKSVIVPVTVGVAVLLVVILLLIALCLCKRNRKPHKHMMIGSVDLGDEDEMRGSESLLYDLSTLRAATANFSEENKLGEGGFGPVYKGTLQNGQEIAVKRLSATSHQGQLEMKNEVVLVAKLQHKNLVRLLGCCIEEREKILVYEFLCNKSLDTILFDTSRQQDLNWEQRFKIIEGIGRGLLYLHEDSRLKIIHRDLKASNILLDVDMNPKISDFGLAKLFNMEASVANTSRIAGTYGYMAPEYALHGIFSAKSDVFSYGVLLLEIVTGRRNTCLHDSEDLLAFVWRHWSRGGAGELLDGCPAAGRRPQELLRCIHVGLLCVQEDPQLRPGMAAVVVMLNSRSVTLPAPSAPAFVSASRGIGGSPPPAAAAGDAPARSTDHEVPTAAR

SEQ ID NO: 19335 - protein, 279 aa, Bacillus thuringiensis serovar konkukian str. 97-27
MKTKTDFLKMKEQGEPITMLTAYDYPSAKLAEEAEVDMILVGDSLGMVVLGYDSTVPVTVEDMIHHTKAVRRGAKETFIVTDMPFMSYHVSLQDTMVNARRIVQESGAHALKVEGAGEVISTIHYLTNAGIPVVAHLGLTPQSVGVLGGYKVQGKDAESAKKLIEDAKKCEEAGAIALVLECVPMQLAELISEQLTIPTIGIGAGQKVDGQVLVYHDLISYGVNRVPKFVKQYTSVQEEIVRGISQYVAEVKTRQFPEEKHSFTMKEEECLALYGGKQS

SEQ ID NO: 19336 - protein, 464 aa, Salmonella enterica subsp. enterica
MSNIILPVVMAGGAGSRLWPLSRALYPKQFLSLTSTNSMLQETIIRLEGIEHEYPLFICNEEHRFIVAEQLRQLSIDHSGIILEPDGRNTGPAIALAAFHALNNGYDPVMLVLAADHEIQERKNFIDSIEIAKQFAENDKLVTFGIVPASPETGYGYIKVGEKIGPDGYKVAAFVEKPHRLLAEEYINSGKYLWNSGMFMFKASVFLNELKKFRPDIYSICETSLLKSESDLDFIRVNGKVFNCCPSESIDYAVMENTMQAVVVPLDAKWSDVGSWTALWDISKKNENGNIIRGDVIAKDTDNCYLHSESRLIGTVGVKDLVIVETKDAVLVAHKNNVQDVKNIVEQLKIQNRQEYLHHREVYRPWGSHDAVADGERFRVKHVTVLPGHAISKQVHYHRAEHWVIVSGTARVYIGDENFLLGENESTFIPVGTVHSIENPGKIPLEIIEVQSGTYLHEDDVERS

SEQ ID NO: 19337 - protein, 647 aa, Brassica napus
MSSAPSPGTGSPPSPPSNSTTTTPPPASAPPPTTPSSPPPPSTIPTSPPPSSRSTPSAPPPSPPTPSTPGSPPPLPQPSPPAPTTPGSPPAPVTPPTRNPPPSVPGPPSNPSREGGSPRPPSSPSPPSPSSDGLSTGVVVGIAIGGVALLVIVTLICLLCKKKRRRDEEDAYYVPPPPPPGPKAGGPYGGQQQQWRQQNATPPSDHVVTSLPPPPKAPSPPRQPPPPPPPPFMSSSGGSDYSDRPVLPPPSPGLVLGFSKSTFTYEELARATNGFSEANLLGQGGFGYVHKGVLPSGKEVAVKQLKVGSGQGEREFQAEVEIISRVHHRHLVSLVGYCIAGAKRLLVYEFVPNNNLELHLHGEGRPTMEWSTRLKIALGSAKGLSYLHEDCNPKIIHRDIKASNILIDFKFEAKVADFGLAKIASDTNTHVSTRVMGTFGYLAPEYAASGKLTEKSDVFSFGVVLLELITGRRPVDANNVYVDDSLVDWARPLLNRASEQGDFEGLADAKMNNGYDREEMARMVACAAACVRHSARRRPRMSQIVRALEGNVSLSDLNEGMRPGQSNVYSSYGGSTDYDSSQYNEDMKKFRKMALGTQEYNATGEYSNPTSDYGLYPSGSSSEGQTTREMEMGKIKRTGQGYSGPSL

SEQ ID NO: 19338 - protein, 369 aa, Spinacia oleracea
MTTAVTAAVSFPSTKTTSLSARSSSVISPDKISYKKVPLYYRNVSATGKMGPIRAQIASDVEAPPPAPAKVEKHSKKMEEGITVNKFKPKTPYVGRCLLNTKITGDDAPGETWHMVFSHEGEIPYREGQSVGVIPDGEDKNGKPHKLRLYSIASSALGDFGDAKSVSLCVKRLIYTNDAGETIKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNEKGEKMYIQTRMAQYAVELWEMLKKDNTYVYMCGLKGMEKGIDDIMVSLAAAEGIDWIEYKRQLKKAEQWNVEVY

SEQ ID NO: 19339 - protein, 476 aa, Escherichia coli
MAKYNINPVILCGGNGTRLWPLSRGLYPKQFLNLDDTSSMLEKTINRLEGLDVSLPLVICNEQHRFIVAEQLRTLKKLNRNILLEPIGKNTAPALALAALYNINFNSNSLLLVLAADHVINDNQSFVTSIKKAIPYAIEGKLVTFGIEPTKPETGYGYIKKGNECSSIAIGDGYHVERFVEKPNFSSACDYISSGEYLWNSGMFLFEPHKYLSELRKYQPDIYNACVDAFKYDLIDNDFIRVDPLSFSQSPSLSVDYAVMEKTSDAVVVPMNAEWSDVGSWAALWEISNKDDDGNVLHGDVISLSTKNSYIYSESELVTTIGIENLAIVQTKDAILVSNLASTQDVKKLVEILQLNGRTEHYVHQERYRPWGKSDTIDTGDSYQVKMLTIMPRENLSMQVHYKRAEHWVVLSGCARIVIDGFESILNENESVHIPVGVKHYLENIGNTPLRIIEIRSGSYLEEDDIIRFSDNDGYV

SEQ ID NO: 19340 - protein, 330 aa, Antirrhinum majus
MSLSCSDCFSDLLCGEDSNIIFSGGGDDLPEYTSDVESIPTDVDESIAGLLEDERDLAGVNSSSSNQSVDSSTRTESTAWILKVQRYYGFQPLTAYLAVSYFDRFLNAHHLPKLNGWPMQLLSVACLSLAAKMEESLVPSLLDLQVEGANFIFEPRNIQRMELLVLRVLDWRLRSISPFCYLSFFALKIDPTGTYTGFLTSRAKEIILSTVQETSLIEYRPSCIAAATMLSSANDLPKFSFITAQHAEAWCDGLHKDNIASCIKLIQGVESNNRPKKQPKVLPQLRVMTRASLASSESSSSTSSSPSYKRRKLNNSSRADDDKESSDYGV

SEQ ID NO: 19341 - protein, 422 aa, Streptomyces coelicolor A3(2)
MTSQPTLTKPEEGPAGPSGPDTGLQAGLKNRHLSMIAIGGVIGAGLFVGSSSGIATAGPGILLSYALVGTLVVLVMRMLGEMSAANPTSGSFSAHADRALGPWAGFSIGWLYWFFWVVVLAVEATAGAKILEGWIPAVPQWGWALIVMVVLTATNLASVGSYGEFEFWFAGIKVVAIAAFIVVGGLAVFGVLPGVDSDRAGLGNLTEHGGFLPHGAGAVLTGVLLVVFSFMGSEIPTLAAGESEDPQRAVTKATNSIIWRIAVFYLGSIFVVVALLPWDSQSIVDQGSYVAALDSLGIPNAGEIMNFIVLTSVLSCLNSGLYTASRMAFSLGRRGDAPKAFARTTRRGVPQAAILSSVVFGFVAVFFNYKFPDTVFLFLLNSSGAVASSSGWPSASRSCGCGRSSRPRRRRSWSCGCGCTRI

SEQ ID NO: 19342 - protein, 109 aa, Brassica napus
MAARAVTMLVVAAVLAGGASAQSTSGCTQTLIGMSPCLNYITGNETAPSKSCCSQLATVVSSKPECLCVALNADPAALGLGAVNKTRALGLPDQCGVKTPPLSNCASAP

SEQ ID NO: 19343 - protein, 252 aa, Prosthecochloris aestuarii DSM 271
MRKKIVVGNWKMNKTIAEAVELSSAIIDQLGEVSASCEVGIAPAFPALSGVHGVISGTGIHLAAQNCHYEDDGAFTGEVSVRMLDEAGCSYVIVGHSERRQYFGDTNPVVNLKVKKALSAGLNVILCVGETLDEREKGITTEVVTCQVKEGLEGVADIGDIVIAYEPVWAIGTGKTASSLQAQEVHASIRATVAGLYSEPAAAGVRIQYGGSVKPSNAEELFAMPDIDGGLIGGASLNAEDFVAIVKAAEKS

SEQ ID NO: 19344 - protein, 877 aa, Phaeosphaeria nodorum
MSAAIDNEDLEELSISMPHPRRGGPSTTKAVDFTTPPVAPPTVMQASKSRDSKASQRLGQYTIVKTLGEGSFGKVKLATHQVSGQKVALKIINRKRLVTRDMAGRIEREIQYLQLLRHPHIIKLYTVITTPTEIIMVLEYAGGELFDYIVNNGRLQEDKARKFFQQIVCAVEYCHRHKIVHRDLKPENLLLDDQYNVKIADFGLSNIMTDGNFLKTSCGSPNYAAPEVISGKLYAGPEVDVWSCGVILYVLLVGRLPFDDEYIPTLFKKIAAGNYSIPSYLSPGAVSLIKKMLMVNPVHRITIGEIRMDPWFTKDIAPYLEPPVQEFFDSGVDPHKAIDPTAIAPAIPAPVVQKLHDTVVTKLGKTMGYAEHDVQEALARDEPSAIKDAYLIVRENQMMKVNPLMTQESQLAPFLAQSPPTHHESYLGSSIPQILNSSSPPKGIPSQAQDQHERARHGSNASSQLASVRSPVSTVAILPSSLTEYHKAYMKGHPRPPFKPEHDGLPPTPDQTEEQRQISARRLKPNFRALPDTTRNRPEPMTSLPAKKPRPTKWQFGIRSRNQPAEAMLAIFKALKAMGADWEVPKIRKAGGKGGSRSPTGSHASQERSRSRSRSRSRSPGSSVSSHDSGDEKKTGSDSPTHEPLTVRNADSGEQRGRQRKHYNHTNDWGYHIPEDPWVINARFRKDGMFPPGVAHPSSTHSSRVDLANDPSGLRRRSSTNTSTTSLSHHIDSMTITDRPNSISGEDHPEADEAVYIYVSIQLYSIDREFFVVDFKCAGYERLVSNLVREVKAASSSSPQHQHEDGWDDEAGVWRRLDEGEPLPDDLAKELRDGGKGVLRERTEEVGAGRKEGEKVVTSPFPFLDVASTLILQLSGE

SEQ ID NO: 19345 - protein, 306 aa, Desulfitobacterium hafniense DCB-2
MFCVVPSDKGELFCCSVLSSLLKKGGKTLKTTKDFWVMKNEGKKIVMITAYDYPSAKQAEQAGADIILVGDSLGNVVLGYDSTVYVTMEDMIHHGKAAKRGAPNTFIVADMPFMSCHLSIRDTLLNGARLIQETGAQAVKVEGADEMIPHIKALVRAGIPVVSHLGLTPQTAAVLGGFKVQGKDGEAARKMLEDVKECQEAGAFALVLECIPKQLAQEISTTLTIPTIGIGAGVHTDGQVLVYHDILTYGVNRAPKFVKAYANADQLMLKGLQDYADEVRSMNFPDDEHSFTMKEEELKTLYGGRG

SEQ ID NO: 19346 - protein, 514 aa, Solanum tuberosum
MDGTAVQGTSSVDSFLRNYKLGKTLGIGSFGKVKIAEHTLIGHKVAVKILNRRKIRNMDMEEKVSREIKILRLFMHGHISRLYEVIETPSDIYVVMEYVKSGELFDYIVEKGRLQEDEARNFFQQIISGVEYCHINMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGYITLPSHLSAGARDLIPRMLIVDPMKRMTIPEIRLHPWFQAHLPRYLAVPPPDTMQQAKKIDEEILQEVVKMGFDRNNLTESLRNRVQNEGTVPYYLLLDNRHRVSTGYLGAEFQESMEYGYNRINSNETAASPVGQRFPGIMDYQQAGARQFPIERKWALGLQSRAHPREIMTEVLKALQELNVCWKKIGQYNMKCRWVPSVPGHHEGMGVNSMHGNQFFGDDSSIIENDGDTKLTNVVKFEVQLYKTREEKYLLDLQRIQGPQFLFLDLCAAFLAQLRVL

SEQ ID NO: 19347 - protein, 484 aa, Burkholderia pseudomallei K96243
MRNESHTARERRRSTKIVATLGPSSSTETAIEALARAGADVFRLNFSHGTHADHALRHAAVRAIEARIGHPIGVLLDLQGPKLRVGQFASGRAQIAKGRPFVFDRDPAPGDARRVSLPHPEIFDAARPGHLLLVDDGKLRFRVDAVSSARIETTALLDGIVSDRKGVSVPDATLAIPALSAKDRDDLEFGLSLGVDWVALSFVQTAQDVRDARALIGARAAIVAKIEKPQAVANIAEIVDAADAVMVARGDLGVEMSLEDVPSVQKQIIRLARAAGKPVIVATQMLESMTLAPTPTRAEASDVAAAVYDGADAVMLSAESASGQYPVEAVDFMRKIISTTEADPIQPQLMKAIVTAHAPNATDAIGAAIEVVSDTLRLGVAVTYTASGATAIRLSRLRPSTAILSLTPRAEIARRLTLAWGVRSRVAAEATGIENIVEIAIEAAHAEGFATDECPIVVAAGVPFGHPGSTNLMRIVWPTEMTRQ

SEQ ID NO: 19348 - protein, 329 aa, Arabidopsis thaliana
MDIDASCSLVLYGKSSVETDTATRLKNNNVLKLPDNSKVSIFLQSEIKNLVRDDDSSFNLSLFMNSISTHRFGRFLIWSPYLSSTHDVVSHNFSEIPVGSVCVSDIQLKGRGRTKNVWESPKGCLMYSFTLEMEDGRVVPLIQYVVSLAVTEAVKDVCDKKGLSYNDVKIKWPNDLYLNGLKIGGILCTSTYRSRKFLVSVGVGLNVDNEQPTTCLNAVLKDVCPPSNLLKREEILGAFFKKFENFFDLFMEQGFKSLEELYYRTCLHSGQKVIAEEKNEDQVVQNVVTIQGLTSSGYLLAIGDDNIMYELHPDGNSFDFFKGLVRRKL

SEQ ID NO: 19349 - protein, 788 aa, uncultured archaeon GZfos32E4
MEETEKDRNIRILHSGVFTPLRRWATKWSLWPCHFLTSCCGVELAHTGACGYDMERLGTLNMGISRQANFIMVEGTITRKMARALRIVWEQMPDPKFVNVIGTCGQRGGIFWNSYNITRPSDIVPVDFFIPGCPITPESLLRGVRAVQEKIEGRDNTTIRFKHVELPSGDGEENRAPTTPKIFAPTPLVRVDVPRDVDWAFGKDLVKNLKAQLNGLYTSITVTDKNRIAIKTSPENLVETSRKLSDTMGVDHVKSVNVIDVPHERKFMVEYMVSGYTEELMPVILTIFTEIGREAEPEIPSLTSLWESANYSERELHDFFGVKFKGNEGMKGKFLLAPDTPDTPLRKDFKLEEEQYTIEEGVPLTPTITPPHYMPPSSSLSYSESELEDLKMPAYEDVLKEAEKNDEFVAFIGPHHSGSGHLRWVMRMKGDIIKDVIPDPGYVHRSMEKIAENRLYIQNVPLTERPNISDPINMNLGYVRAIENALGIEVPERAKYIRTIMAELSRIGAFFYDMGIFPLFMGHSTGFMYSFAIREMVLELMVRMTGSRCTPSFIIPGGIRRDIPDDVLDRTRKFTTAIHKRLKKYENIFVYNPVLISRMKEVGVLTREEAIRCGIVGPFLRASGVEYDVRKAEPYEVYDKLDWEATTGDAGDCLGRIFGRLEEMKQSVEIVRQAVDAVQEMPRGGVISEEILGDYKEASDDIRGYLYNVYGDLVLPKGEWTSVTEAARGTVLYSIISDGESNVPYRVRIITPCWMNLRGIIEASKGERVADFWTVYASFGYFPPEADR

SEQ ID NO: 19350 - protein, 394 aa, Zea mays
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERCSARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19351 - protein, 394 aa, Zea mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLTPKGWKVQLWYRSVHMDPQVYPDPTKFDPLRWEGHSPRAGTFL

SEQ ID NO: 19352 - protein, 471 aa, Zea mays
  misc_feature (205)..(205): Xaa can be any naturally occurring amino acid
  unsure (1)..(471): unsure at all Xaa locations
MESKPHAPASGLATPRFRLGKQSSLAPERGGEGGGAGSADGSAEANGVMSFQLMYLAHEGSAEGIRELLDGGVDPNFRDSDGRTALHIAACEGHAEVVELLLQSGAEAAVEDQWGSTPLADAMHYQNHDVIKIFEKHGSKHKIAPMHVNNVREVPEYEIDPAELDFSNGNDLSKGTFRKATWRGIPVAVKKLDDDLIADGSKVQXFRDELDVLQLIRHPNVVQFLGAVTQSNPMMIVMEFMRKGDLRTHLSKKGALPPSYAVKLALDIARGMNYLHEHKPQAIIHRDLEPSNILRDDTGHLKVADFDLCKMLKWRRKVREDKAVTSPGNACKYVAPEVLRNEEYDTKVDVFSFALILQEMIEGCLPYYDKKNDEIEKAHNSKERPPFRAPPKHYAHGLRELIEQCWSENSADRPDFRVIINRLSAIQNEIAHRNRWKARPLKCFLSIEGMWKKDRNEGSTTRSSRSSRSYF

SEQ ID NO: 19353 - protein, 394 aa, Zea mays
  misc_feature (29)..(29): Xaa can be any naturally occurring amino acid
  misc_feature (36)..(36): Xaa can be any naturally occurring amino acid
  misc_feature (391)..(391): Xaa can be any naturally occurring amino acid
  unsure (1)..(394): unsure at all Xaa locations
LGAERRARLPPGEMGWPLVGGMWDFLRAXKSGKPDXFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVNMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAXTFL

SEQ ID NO: 19354 - protein, 402 aa, Legionella pneumophila str. Lens
MKHSLATIEEAVATLKAGKMIILMDDEDRENEGDLVIAAEHATPEAINFMSRLGCGLICLPMAEELIDKLELPMMARHNKSPYGTAFTVSIEAANGVSTGISARDRARTIQVAIDPKSGPSDIISPGHVFPLRARKRGVLERPGQTEGSVDLVKLAGLTPAAVICEIINEDGTMSRRDELALFSKKHQIPLVTIKDLIQYRVRHENLIHPVATTQIPLEENGVFTMTVFENQIDSCEHFVLVKPPLYGNQVPLVRIHSECITGDVFGSRKCDCGKQLELSLSQIGAEGGILIYLRQEGRGIGLANKLKAYALQEQGFDTVDANLELGLPADDRDYAVAYQILKYLGVEALRLLTNNPLKIASLERYGMKITQRIPLEIEPSRENHSYLKTKKIKLGHLLAID

SEQ ID NO: 19355 - protein, 244 aa, Mycoplasma genitalium G37
MRTRYLIGNWKTNKNLKDAVSFVEQFQQNKLNYNAKIGIAPVYVHLTEIKKIISDSLLLFAQDANFIESGSYTGTVSFTQLQDIGVNNSIIGHSERRKYYNETSAVINQKLFACLKASMQVVLCIGEALGQEISFLKTDLTNCLDTIDKSLIKNLVIAYEPLWAIGTGKTATPEVANQTIKTIREYINDLYDENVANNISILYGGSVDHNNIQKLAIMEQIDGFLVGKASLEIKNFLEMARVYA

SEQ ID NO: 19356 - protein, 394 aa, Zea mays
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLSLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19357 - protein, 459 aa, Bacillus subtilis subsp. subtilis str. 168
MIGNSSKDNFGQQQKLSRGLKNRHIQLMAIGGAIGTGLFLGSGKSIHFAGPSILFAYLITGVFCFFIIRSLGELLLSNAGYHSFVDFVRDYLGNMAAFITGWTYWFCWISLAMADLTAVGIYTQYWLPDVPQWLPGLLALIILLIMNLATVKLFGELEFWFALIKVIAILALIVTGILLIAKGFSAASGPASLNNLWSHGGMFPNGWHGFILSFQMVVFAFVGIELVGLTAGETENPQKVIPKAINQIPVRILLFYVGALFVIMCIYPWNVLNPNESPFVQVFSAVGIVVAASLINFVVLTSAASAANSALFSTSRMVYSLAKDHHAPGLLKKLTSSNVPSNALFFSSIAILIGVSLNYLMPEQVFTLITSVSTICFIFIWGITVICHLKYRKTRQHEAKANKFKMPFYPLSNYLTLAFLAFILVILALANDTRIALFVTPVWFVLLIILYKVQTQQRT

SEQ ID NO: 19358 - protein, 394 aa, Zea mays
LGAERRARLPPGEMGWPLVGGMWAFLRAFKSGKPDAFIASFVRRFGRTGVYRSFMFSSPTVLVTTAEGYKQVLMDDDAFVTGWPKATVALVGPRSFVAMPHDERRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQDVLDERRAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 19359 - protein, 367 aa, Shewanella oneidensis MR-1
MALHSIEEIIEDIRQGKMVILMDDEDRENEGDLILAAEMVTPEAINFMAKYGRGLICQTMTKARCQQLNLPLMVTNNNAQFSTNFTVSIEAAEGVTTGISAHDRAVTVKAAVAKDAKASDLVQPGHIFPLMAQDGGVLTRAGHTEAGCDLARLAGLEPSGVIVEILNEDGTMARRPDLEIFSEKHGIKIGTIAALIEYRNTKETTVVREAKCKLPTRFGEFDMVTFRDTIDNQLHFALVKGEVKPDCLVRVHLQNTFNDLLHSERDQQRSWPLEKAMARISAEGGVLVLLGNQEHSSEILAKVKAFEAEDQGQTPVSAKWQGTSRRVGVGSQILASLGVTKMRLLSSPKRYHSLSGFGLEVTECVAE

SEQ ID NO: 19360 - protein, 534 aa, Rhodobacter sphaeroides 2.4.1
MPDMAPRVLVSDELSETAVQIFRDRGVEVDYMPKLGKDKEKLAEIIGQYDGLAIRSATKVTEKLLEQATNLKVIGRAGIGVDNVDIPAASRKGVIVMNTPFGNSITTAEHAIAMMFACARQLPEANASTHAGKWEKSRFMGVELFNKTLGVIGAGNIGGIVCDRALGLSMKVVAYDPFLSEERAKALGVTKVELDDLLARADFITLHVPLTDKTRNILSAEAIAKTKKGVRIINCARGGLVDEKALAEAIKSGHVAGAAFDVFEVEPASESPLFNLPNVVVTPHLGASTTEAQENVALQVAEQMSDYLLTGAVQNALNMPSVTAEEAAVMGPWVKLAGHLGAFVGQMTDEPIKAINVLYDGAVGEMNLAALNCATIAGIMKATNPDVNLVSAPVVAKERGIQISTTTQAKSGAFDAYIKLTVVTDKRERSVAGTCFSDGKPRFIQIKGINIDAEVGRHMLYTTNEDVPGIIGLLGMTMGKNGVNIANFTLGRTSVGQEAIAILYLDQAIDPKVVETLESTGLFQQVKPLEFDVA

SEQ ID NO: 19361 - protein, 467 aa, Escherichia coli
MLLPVVMAGGSGTRLWPLSRTLYPKQFLSLTSRLTMLQETLRRLEGVEHRPALVICNEVHRFIVAEQMRNEHLANSGILLEPKGRNTAPAVALAALKAVSSGEDPILLVLAADHDIQDQERFISSILAAKEFAEEGKLVTFGIVPTKPETGYGYIKTGENLNEYGFKVSAFVEKPELDVAKKYLEDGGYLWNSGIFMFRASVFIDELNKFRPDILKICQQALKSSTQDLDFIRIDNDSFSCCPEESIDYAVMEKTTEAVVVPLNAHWSDVGSWSALWEISSKDKSGNAIRGDVLIHDSSDSYLYSQHRLIGVVGVKDLVVVETKDAILVAHKDKVQKVKNIVEQLKVNNRAEYQQHREIFRPWGSHDSIAEGSRFQVKHVVIHPGHKTAKQIHYHRTEHWIVVSGTAKVHYEDEIFLVSENESTYIPIGVPHFIENPGKIPLEIIEVRSGVYLDEDDVVRILNDDGY

SEQ ID NO: 19362 - protein, 731 aa, uncultured bacterium
MVVLDAFQKYLNHFNFTWYNLMVRPKKHLGQHFLTNRSVSRRIVDALRYRPGDTVLEIGSGKGILTEPLMELDIQLVTVEIDQESIRYLLDKWPDLKGSLIQDDFLKVDLQRICGRPFHIIGNFPYNISSQIFFRILEYRHLVTSVVCMVQKEVADRIASPPGSKEYGILSVLLRAYFDIESLFSVKPGSFFPPPQVTSGVIRLTRNQTETLPCDEALFFRVVKTLFNQRRKMIRNSIKSILLHLDNHDESEKTPRGAGRSRVHRTDQLDKGPAISDTMNSELTREYINELRTIIETKDDEAALDKLQDLHPADLAEIYVNLTIEEAKYLYLLLDPQRASDVLVELEEDDREKFLNALPSEVIASQFIHHMDSDDAADVIQDLDDDKKQEVLLHIDDVEQAGDIVDLLGYDEDSAGGLMAKELIRVNENWGVATCIREMRKQAKDLDEIYYIYVVNDENVLLGILSMKSLLLASASTKVKDIYDGEVRSVRTNTSSEEVAQIMEKYNLIVLPVTDSIGRLVGRITIDDVVDVIRDEAERDYQLASGITTDVETTDSPARLSRARLPWLIIGLVGGVIVAAVISRFEEDIKINPEMAFFIPLIGAMAGNVGIQSSAIIVQGIASNSLGLESTYQKLMKELLVALLNGFILAGLLFLYNYLFSHKLALTFTVSTSLFVVIIFASLFGTLIPLLLNKMKFDPALATGPFITTMNDIMGLMIYFLMGRVLYTIFV

SEQ ID NO: 19363 - protein, 461 aa, Escherichia coli
MLLPVVMAGGSGTRLWPLSRTLYPKQFLSLTSRLTMLQETLRRLEGVEHRPALVICNEVHRFIVAEQMRNVNLANSGILLEPVGRNTAPAVALAALKAISSGEDPILLVLAADHEIQDQKRFISSILAAKEFAEEGKLVTFGIVPTKPETGYGYIKTGENLNEYGFKVSAFVEKPELDVAKKYLEDGDYLWNSGIFMFRASVFIDELNKFRPDILKICQQALKSSTQDLDFIRIDNDSFSCCPEESIDYAVMEKTTEAVVVPLNAHWSDVGSWSALWEISRKDKSGNAIRGDVLIHDSSDSYLYSQHRLIGVVGVKDLVVVETKDAILVAHKDKVQQVKNIVEKLKVNNRTEYLQHREIFRPWGSHDSIAEGSRFEVKHVVIHPGHKTAKQIHYHRTEHWIVVSGTAKVHYEDEIFLVSENESTYIPIGVPHFIENPGKIPLEIIEVRSGVYLDEDDVVRI

SEQ ID NO: 19364 - protein, 479 aa, Escherichia coli
MNNNKIITPIIMAGGSGSRLWPLSRILYPKQFLSLIGSHTMLQTTANRLDGLDCTNPYVICNEQYRFIVAEQLRKIDRLTSKNIILEPVGRNTAPAIALAALLMSKSDKSADDLMLVLAADHVIHDEEKFCNAVRSAIPYAADGKLVTFGIIPDKAETGYGYIHRGQYINQEDSDAFIVSSFVEKPNHETATKYLASGEYYWNSGMFLFSANRYIEELKQFRPDILSACEKAIASANFDLDFVRLDESSFSKCPEESIDYAVMEKTKDAIVIPMDAGWSDVGSWSSLWEINDKDSDGNVIVGDIFSHETKNSFIYAESGIVATVGVENLVVVQTKDAVLVSERNKVQDVKKIVEQIKNSGRSEHYVHREVYRPWGKYDSIDTGERYQVKRITVNPGEGLSLQMHHHRAEHWIIVSGTARVTIGSETKILSENESVYIPLGVIHCLENPGKIPLDLIEVRSGSYLEEDDVIRFQDRYGRS

SEQ ID NO: 19365 - protein, 355 aa, Aspergillus oryzae
MSGHENNGAPPVGQEKINTDIVTLTRFLTEEQTKVPEATGDFTLLCHALQFSFKSIAYYIRRASLINLTGLAGSSNTTGDDQKKLDVIGNDIFISAMRGSGKCRILVSEEEEEAIIFDEHPYARYAVVCDPIDGSSNLDAGVSVGTIFGIFKLPDSVLGPENKVSPKDLLLPGTEMVASGFTMYGASAQLVITMRNGGVNGFTLENSLGEFILTHPNMTLPAKRAIYSVNEGNSSYWEEWTNAYFHSLKFPPEGQKPYSARYIGSMVADAYRTLLYGGVFAYPADKKAPKGKLRILYECAPMAMLFENAGGLAVNSRMERLLGVVPEHIHDKSGVFLGSKDEVQKIIDTYNKYKK

SEQ ID NO: 19366 - protein, 476 aa, Brucella suis 1330
MYPNLTLIVGGEERNKGSAGTLCLTDPADGRELTIAPRAGRAEALQAAAAEKGFAEWSALSALERSKIMRRAADIMRERADAAARIMSMEQGKPLAEARGEWLGSADLLDWFAEEGRRVYGRIVPSRAPNIQIQVLKHPIGPVAAFTPWNFPAWNTMQKVAPALGAGCSVVIKPASDTPGTAWLIGKCLLEAGLPPKAVSVIWGTTSELSDALIKAPEFRKVSLTGSTRVGRIVAAQAGEYLKKVTMELGGHGPVIVAADADLDHLIPLAVQWKFRNCGQVCVSPTRFIVEASIHDEFIRRFSEKARELKVGKGVEEGTQMGPLTSQNQLETVLSMVEDALTKGAKIETGGNRIGDTGNFYEPTILSGMTAEMLAMNEEPFGPLALVMRVHSLDEAIAESNRLPVGLGAYLFTSSMTTAHRVQNHLQAGMLGVNHFALALPETPFGGVRDSGFGSEGGLEGIEAYLTTMTVTTMMV

SEQ ID NO: 19367 - protein, 440 aa, Arabidopsis thaliana
MYLDINGVMIKQFSFKASLLPFSSNFRQSSAKIHRPIGATMTTVSTQNESTQKPVQVAKRLEKFKTTIFTQMSILAVKHGAINLGQGFPNFDGPDFVKEAAIQAIKDGKNQYARGYGIPQLNSAIAARFREDTGLVVDPEKEVTVTSGCTEAIAAAMLGLINPGDEVILFAPFYDSYEATLSMAGAKVKGITLRPPDFSIPLEELKAAVTNKTRAILMNTPHNPTGKMFTREELETIASLCIENDVLVFSDEVYDKLAFEMDHISIASLPGMYERTVTMNSLGKTFSLTGWKIGWAIAPPHLTWGVRQAHSYLTFATSTPAQWAAVAALKAPESYFKELKRDYNVKKETLVKGLKEVGFTVFPSSGTYFVVADHTPFGMENDVAFCEYLIEEVGVVAIPTSVFYLNPGEGKNLVRFAFCKDEETLRGAIERMKQKLKRKV

SEQ ID NO: 19368 - protein, 165 aa, Zea mays
PTRPPCIGFAMLLMDLSGRRFLLLGTIPILIASLVILVVSNLIDLGTLAHALLSTVSVIVYFCCFVMGFGPIPNILCAEIFPTRVRGLCIAICAFTFWIGDIIVTYSLPVMLNAIGLAGVFSIYAVVCLISFVFVFLKVPETKGMPLEVITEFFAVGAKQAAAKA

SEQ ID NO: 19369 - protein, 578 aa, Neorickettsia sennetsu str. Miyayama
MFDDGITLFQVIALLSTAVLVVALFLKLNISPILGYFVAGAVLGTHGFKIVTFSSPMETFAEFGIVFLLFLIGLELTLDRIMSMRLHVFGLGTLQVIITALLIILICRIFGNSSSASIIIGCAFALSSTAIVLQVLQETGMESNQVGRLSIAVLLMQDFTVVPLLVLVALLGNNAPQNLLLPIAMSLIRAGLVLLLIFVAGRLLLRPFFKIIASTKSSELFIATTLLIVLGAAYITEKLELSMAMGAFVAGLLLAETEYRHEVEQVIFPFKSLLLGLFFMTVGMSIDLRMLVENIGLITGIALALMTLKASIVIGLAKLFGFKTGPAINAGLLLAQGSEFALILFKLDSSTTILDASMVNILVSSVTMSMAFTPLFSSIGTMVANKLEAPDRIVEEDELIQLMRASVADIDNHVVIAGFGRVGRMVARMLAEERINYIAIDVDSKIVEKAQDEGFPIFKGNINKRATLDAIAADRASTIVLSMQNGVTSKKAVALIGQSFPHATIVARVADFSDIKTYRKLGAHKLVPETYETGLQIGAEVLQSVGLGSFAIASLKERFRACDYAIPKSIAKEEEPPS

SEQ ID NO: 19370 - protein, 157 aa, Oryza sativa
MAKLYVQAVPPPDLNRNTEWFMYPGVWTTYICILFFSWLLVLSVFGCTPGMAWTVVNLFHFAITYHFFHWKKGTPFADDQGMYNTLTWWEQMDNGKQLTRNRKFLVVVPVVLYLIASHTTDYQHPMLFLNTLAAAVLVVAKLPNMHKVRIFGINAGN

SEQ ID NO: 19371 - protein, 444 aa, Xylella fastidiosa 9a5c
MNHSRSHTLFVQAQTRIPGGVNSPVRAFRSVGGEPFFVARADGPYLFDVDGHRYIDYVGSWGPMIVGHNHPAVREAVQVAISNGLSYGAPCAAEVTMAETIARLVPSCDMVRMVNSGTEATLSAIRLARGATGRNHIVKFEGCYHGHGDSFLVKGGSGMLTLGMPSSPGVPAELSKLTITLTYNDFDAATALFEEMGHHIAAVIVEPVIGNANCIPPRPGYLQHLRTLCTQYAVLLIFDEVMTGFRVALGGAQALYGVTPDLTTFGKIIGGGMPVGAYGGCRDLMQHIAPAGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPDIIEATLEAARAAFQTIANEAAILSESEAPLKMP

SEQ ID NO: 19372 - protein, 238 aa, Lycopersicon esculentum
MADPDTTRTVVGIIGNVISFFLFLSPGPTFVQILKAKSVMEFKPDPYIATVLNCAVWVFYGMPFVHPDSLLVITINGFGLAIELLYVSIFFIYSDWSKRQKIIIALVIEAIFMAILIFVTLTFLHGTKDRSMLIGIVAIVFNIIMYTSPLTVMKKVITTKSVKYMPFYLSLANFANGIVWACYALLKFDPYILIPNGLGSLSGLVQLILFAAFYRTTNWDEDEKEVELSTSKSNKSDV

SEQ ID NO: 19373 - protein, 378 aa, Arabidopsis thaliana
MESDLIDLFEGAKKAADAAALDGVTSSGPEVSQCIDALKQLKKFPVTYDTLVATQVGKKLRSLAKHPVEDIKSVATDLLEIWKKVVIEETAKAKKTEGTNGCKEAKVNKMDVEKPSNPAPVKVQKLQRGDSAKSIKVERKEPDNKVVTGVKIERKVPDIKVTNGTKIDYRGQAVKDEKVSKDNQSSMKAPAKAANAPPKLTAMLKCNDPVRDKIRELLMEALCRVAGEADDYERESVNASDPLRVAVSVESLMFEKLGRSTGAQKLKYRSIMFNLRDSNNPDLRRRVLTGEISPEKLITLSAEDMASDKRKQENNQIKEKALFDCERGLAAKASTDQFKCGRCGQRKCTYYQMQTRSADEPMTTYVTCVNCDNHWKFC

SEQ ID NO: 19374 - protein, 487 aa, Corynebacterium efficiens YS-314
MSPPHPQRVRLVDVERRTKIVCTLGPAVASADGILRLVQDGMDVARLNFSHGDHPDHEQNYKWVREATDKTGRAVGILADLQGPKIRLGRFKEGSTVWETGETVRITVDDVEGTHDRVSTTYKNLAKDARPGDRLLVDDGKVGLVCVSVEGNDVICEVTEGGPVSNNKGVSLPGMDISVPALSEKDIKDLRFALKLGVDFIALSFVRSPADVELVHAIMDEEGRRVPVIAKLEKPEAVAALESIVLAFDAIMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRLARLHSHLPLLVFTPDPSVRSQLALTWGAQTFLCPKVDDTDGMMREVDRALLAMDEYQKDDMMVVVAGSPPGVTGNTNMIHVHLLGEDTRIPK

SEQ ID NO: 19375 - protein, 1054 aa, Bacillus subtilis subsp. subtilis str. 168
MKQASAIPQPKTYGPLKNLPHLEKEQLSQSLWRIADELGPIFRFDFPGVSSVFVSGHNLVAEVCDEKRFDKNLGKGLQKVREFGGDGLFTSWTHEPNWQKAHRILLPSFSQKAMKGYHSMMLDIATQLIQKWSRLNPNEEIDVADDMTRLTLDTIGLCGFNYRFNSFYRDSQHPFITSMLRALKEAMNQSKRLGLQDKMMVKTKLQFQKDIEVMNSLVDRMIAERKANPDENIKDLLSLMLYAKDPVTGETLDDENIRYQIITFLIAGHETTSGLLSFAIYCLLTHPEKLKKAQEEADRVLTDDTPEYKQIQQLKYIRMVLNETLRLYPTAPAFSLYAKEDTVLGGEYPISKGQPVTVLIPKLHRDQNAWGPDAEDFRPERFEDPSSIPHHAYKPFGNGQRACIGMQFALQEATMVLGLVLKHFELINHTGYELKIKEALTIKPDDFKITVKPRKTAAINVQRKEQADIKAETKPKETKPKHGTPLLVLFGSNLGTAEGIAGELAAQGRQMGFTAETAPLDDYIGKLPEEGAVVIVTASYNGAPPDNAAGFVEWLKELEEGQLKGVSYAVFGCGNRSWASTYQRIPRLIDDMMKAKGASRLTAIGEGDAADDFESHRESWENRFWKETMDAFDINEIAQKEDRPSLSITFLSEATETPVAKAYGAFEGIVLENRELQTAASTRSTRHIELEIPAGKTYKEGDHIGILPKNSRELVQRVLSRFGLQSNHVIKVSGSAHMAHLPMDRPIKVVDLLSSYVELQEPASRLQLRELASYTVCPPHQKELEQLVSDDGIYKEQVLAKRLTMLDFLEDYPACEMPFERFLALLPSLKPRYYSISSSPKVHANIVSMTVGVVKASAWSGRGEYRGVASNYLAELNTGDAAACFIRTPQSGFQMPNDPETPMIMVGPGTGIAPFRGFIQARSVLKKEGSTLGEALLYFGCRRPDHDDLYREELDQAEQDGLVTIRRCYSRVENEPKGYVQHLLKQDTQKLMTLIEKGAHIYVCGDGSQMAPDVERTLRLAYEAEKAASQEESAVWLQKLQDQRRYVKDVWTGM

SEQ ID NO: 19376 - protein, 241 aa, Zea mays
  misc_feature (95)..(95): Xaa can be any naturally occurring amino acid
  unsure (1)..(241): unsure at all Xaa locations
MQYAKLLPLALIHMLGNVFTNMSLGKVSVSFTHTIKAMEPFFSVLLSILFLGETPSLPVLGSLVPIVGGVVLASMTEVSFNWIGFWSAMTSNLMXQSRNVYSKKILADKEDSLDDINLFSIITVMAFLLSAPLMLCVEGIKFSPSYLQNAGVNVKELFIRAALAGTSFYFYQQVSYSLLARVSPVTHSVANSLKRVVVIVSSVLFFRTLISPINALGTGVALAGVFLYSQFKKSKPKATAA

SEQ ID NO: 19377 - protein, 519 aa, Lotus japonicus
MTEGKVVTEAENANQKNLQDFDPQKKPKRNKYAFACAMLASMTSILLGYDIGVMSGAAIYIKRDLKVSDVKIEILLGIINLYSLIGSGLAGRTSDWIGRRYTIVFAGAIFFVGALLMGFSPNYWFLMFGRFIAGIGIGYALMIAPVYTAEVSPASSRGFLTSFPEVFINGGILLGYISNFAFSKLSLKVGWRMMLGVGALPSVILGVGVLAMPESPRWLVMRGRLGDAIKVLNKTSDSPEEAQLRLADIKRAAGIPESCTDDVVEVSKRSTGEGVWKELFLYPTPAIRHIVIAALGIHFFQQASGIDAVVLYSPTIFEKAGIKSDTDKLLATVAVGFVKTCFILVATFMLDRIGRRPLLLTSVGGMVLSLLTLGTSLTIIDRSDTKVTWAVGLSIATVLSYVATFSIGAGPITWVYSSEIFPLRLRAQGCAMGVVVNRVTSGVISMTFLSLSKGITIGGAFFLFGGIAICGWIFFYTMLPETRGKTLEDMEGSFGQSKSKIKGNKGVGNGKDNDQAGQV

SEQ ID NO: 19378 - protein, 961 aa, Kineococcus radiotolerans SRS30216
MTSPTPLRTELPEFAPEPAALPFSARHIGPDAAAVARMLQVVGLTSTEELVDRAVPAGIRDGVLDLPEALDETSVTAALRELAGRNRVVPSMIGLGYFGTRTPAVVRRNVLEDPSWYTAYTPYQPEISQGRLEALLNFQTAVTDLTGLDVANASLLDEGTAAAEAMTLARRTSKAPRGAVFAVDADVLPQTLAVLRTRAVPLGIDLVTVDLDTPDPLSVVGECGVFGVLLQYPGTSGRVRDLAAVVADAHARGALAITAADLLALTLLVAPGEFGADVAVGSSQRFGVPMGAGGPHAAYMAVRKGIERSLPGRLVGVSVDADGNTAYRLALQTREQHIRRDKATSNICTAQVLLAVMAGCYAVWHGPEGLRAIASQVARRAAGIAAALRAGGVEVVHDTFFDTVLARVPGRAGDVVAAALAAGVNLRLVDADHVGLTVDETTSEAHVAAALRGFGLDPVEATADPALPAALRRTSDFLTHPVFSRHRSETAMLRYLRRLSDADYALDRGAIPLGSCTMKLNATTELEPVSWPEFADLHPYAPADQLAGTAQLVADLEGWLAEVTGYDAVSLQPNAGSQGEFAGLLAIRAYHLAQGRGERTVCLIPSSAHGTNAASAVMAGLRVVVVTCDEGGNVDLDDLRAKVAEHADDLAALMVTYPSTHGVYEESIREVCGLVHDAGGQVYVDGANLNALVGLARPGKFGADVSHLNLHKTFCIPHGGGGPGVGPVAVREHLAPFLPSTAPGGDLDGRGVGMVSAAPFGSAGILPIPWAYLRLMGPDGLRAATVQAVLSANYVAARLADAFPVLYRGPGGLVAHECILDLRPMTKATGVTVDDVAKRLVDHGFHAPTMSFPVAGTLMVEPTESEDLAELDRFCDAMLAIAAEVREIADGRWAVEDSPLRHAPHTAASLVGEWNHPYTREEAVYPNGMDPRSKYWPPVRRIDGAAGDRNLVCSCPPLSEY

SEQ ID NO: 19379 - protein, 271 aa, Xanthomonas oryzae pv. oryzae KACC10331
MSSHADSNPWTVPALAQAKRAGRKLVMLTAYDASFARTFDVNGVDLILVGDSLGMVMQGHDSTLAVTTADMVYHTAAVARALDRALLVADLSFQADATPERALDAATQLLQAGAEMVKIEGAGHKLEVIRYLVEREIPVCSHLGLTPQSVLRFGGYKVQGRGEAGEQLRRDAQAVVDAGASLVVLECVPTPIATQISAELSVPTIGIGAGPGCDGQVLVMHDMLGLDSGHRRPKFVKDFLAEGGSVAGAVRAYAQAVRDGSFPDAEHAYAA

SEQ ID NO: 19380 - protein, 339 aa, Bordetella bronchiseptica RB50
MKRKTLTQYLVEQQRSAQALGPEVRLLIEVVARACKAISHAVSKGALGGVLGSLESENVQGEVQKKLDVLSNEILLEANEWGGHLAAMASEEMETIHLIPNRYPKGEYLLLFDPLDGSSNIDVNVSIGTIFSVLRAPHRVAGADVCEQDFLQPGSQQVAAGYAVYGPQTMLVLTIGNGVVGFTLDREMGSWVLTHESMRIPEDTKEFAINMSNMRHWAPPVKRYIDECLAGKTGPLGKDYNMRWIASMVADVHRILTRGGIFMYPWDAREPGKAGKLRLMYEANPMGLIVEQAGGAAIDGTGRILDIQPDKLHQRVSVILGSKNEVERVGRYHAEAHAS

SEQ ID NO: 19381 - protein, 237 aa, Glycine max
TAKMVNDDEWVRAAMEDDTVVVELLLRLKQGTVLHKSHHQQLLPFSWGVKQPRSRSRLTSAAVSRCDAAVSTRCSPTTPLSWSAGADSYEDSSRHHHHHAAVSKATATSGYTGNSASTKRCRRKKTFAELKEEESSLLKESIYLKKEIASVNANFEAQRAKNESLKRMKLDVGSKYQNNPSSTSALIRPIQEDTHSLASESRPNRIKSTGESFFLIPDLNMVPSEDVSCTDALCGMS

SEQ ID NO: 19382 - protein, 419 aa, Rhodococcus sp. RHA1
MTTTVALIAALDTKADDAGYIRARLREHGLRVHLIDVGVLDEPLLHADSTREEVADSAGMDLGVLRRRHDRSSAVDVMGAGARRIVEDLVATESIQGVFALGGGAGTTIGSIVMRDLPLGFPKAILSTVASGNTANYVGTSDIVMFPSIVDVAGLNRISSVTYTQAADAFAGMVNGLSTRPDVSPTADRPLVAASMFGVTTQAVMCAKSILENAGCEVVVFHATGTGGRTMERLISEGYFDAVLDLTTTEWSDEVVGGILSAGPTRLESAARHGVPQVVSLGATDMVNFGAPDTIPGTFANRLLYHHNAENTLMRVTSDEARQIGEAIGRKLRLATGPCTLLIPLRGTSALDAEGEPFDRPEARRDLFDAVKSSLDGSAVTVIDIDQHINDEVFATSAARLLLDYLSHVPYTAQASNHA

SEQ ID NO: 19383 - protein, 284 aa, Oryza sativa
MAAPPQPVPAPAAASPEVFRLGFIGPGNLAESIARGVAASGVLPATAIRTAPHRRPERAEAFSSIGAHILETNAQVVDDSDVIVISVKPQIVRQVLVELKPLLSEEKLLVSIAAGIKMEDLQGWSGHRRFIRVMPNTPSAVGQAASVMCLGEMATENDENRVRSLFSAIGKVWTAEEKYFDAVTGLSGSGPAYIFLAIEAMADGGVAAGLPRDLALGLASQTVLGAATMVNKTGKHPGQLKDMVTSPAGTTITGIQELEKGAFRGTLINAVVAATKRCRELSQS

SEQ ID NO: 19384 - protein, 278 aa, Rhodococcus sp. RHA1
MSFTREQVVDRLNTQVSDQRPIVGAGAGTGISAKFIERGGADVIIVYNSGRFRMAGHSSMCGLLPLGDANAIVLEMGEREVLPVVHNTPVIAGVNGTDPTRDMRRLLEQVAAAGFSGVNNFPTVGLFDGRIREELEASGLGFQREVEMIEIAHQLGLFTIVYVFTPQEAAAMAAVGADAVIAHMGLTVGGSIGMSTDGAFSLEDACDRVQAIGEAALAAKADVIVLCHGGPIATPSDAEYVMKRSNAVGFVGASSMERLPVEEALTQTTAAFKATTTA

SEQ ID NO: 19385 - protein, 478 aa, Shigella flexneri 2a str. 301
MAQSKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAKRHSPESDPLMLVLAADHVIADEDAFRAAVRNAMPYAEAGKLVTFGIVPDLPETGYGYIRRGEVSVGEQDTVAFEVAQFVEKPNLETAQAYVASGEYYWNSGMFLFRAGRYLEELKKYRPDILDACEKAMSAVDPDLDFIRVDEEAFLACPEESVDYAVMEPTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 19386 - protein, 375 aa, Brucella suis 1330
MKFKAAVLDRHGVERPYNQTKPLVIREIELREPKADEVLVKLAASGLCHSDLSVINGDRSRQIPMVLGHEAAGVVEKIGEGVTDLVPGDHVVCVFVPNCGHCQPCAEGRPALCEPGAAANGKGEMLSGGLRLFCDDGDVYHHCGVSAYAEYAVMSRYSIIRIEKDIPLHIAALMGCAVLTGTGSIFNTGLVKPGSRVAIAGLGGVGLAAVMGAVAAGATEIIALDMFDDKLALAEQLGATKTFNVQSEGVVEAVKEYTKGGVDAAFEYAGSGAALAMCYALTKRGGEVVTAGLPNPKNMLSIPAVSLVAEEKSIRGSYLGSGVPTRDIPLFLDLYRKGKLPVEKLLTHRIKLEEINEGFERLAAGKAIRQVVEFN

SEQ ID NO: 19387 - protein, 264 aa, Arabidopsis thaliana
MEEERVAVTGVGTTRYALKPGRIKSEDILICIDVDAESMVEMKTTGTNGRPLIRMECVKQAIILFIHNKLSINPDHRFAFATLAKSAAWLKKEFTSNAESAVASLRGLSGNKSSSRADLTLLFRAAAQGAKVSRAQNRIFRVILIYCRSSMRPTHEWPLNQKLFTLDVMYLHDKPSPDNCPQDVYDSLVDAVEHVSEYEGYIFESGQGLARSVFKPMSMLLTHPQQRCAQDDLDIPMSLAKKVPVTEAASAVDPHNGNNIQIIN

SEQ ID NO: 19388 - protein, 400 aa, Mesorhizobium sp. BNC1
MAFLADALSRVKPSATIAVTQKARELKAQGRDVIGLGAGEPDFDTPDNIKQAAIEAIKRGETKYPPVSGIQPLREAIAAKFKRENNLDYDWKQTIVGTGGKQILFNAFMATLNPGDEVVIPTPYWVSYPEMVSICGGTSVFAETRLEDNFKLQPEVLERAITPRTKWLIMNSPSNPSGAAYTREELKAVADVLLKHPHVWVLTDDMYEHLTYGDFTYHTIAEVEPQLYGRTLTMNGVSKAYAMTGWRIGYAAGPIELIKAMDMIQGQQTSGAATVCQFAALEALTGPQDFIHQSKKVFQERRDLVVSMLNQAKGISCPVPEGAFYVYPSCAGTIGKKAPSGKLIESDTDFVSELLETEGVAVVQGSAFGLGPNFRISYATSDALLEEACSRIQRFTANLR

SEQ ID NO: 19389 - protein, 214 aa, Desulfovibrio vulgaris subsp. vulgaris str. Hildenborough
MNQHLLEQFGTTHERVERGLAALRTGQGVLVADDADRENEGDLIFAAETLTPAQMAMMIRECSGIVCLCLPEERVSRLGLPMMVAHNTSSMGTAFTISIEAAEGVTTGVSAADRVRTVKAAIDDAACPGCLRSPGHVFPLRASPGGVLERRGHTEATVDLMRLAGLKPYGVLCELTNPDGTMARLPQLVDFAQRNRMTVLTVEDLVAYRQDKGL

SEQ ID NO: 19390 - protein, 773 aa, Anabaena variabilis ATCC 29413
MQEDFRLIVDLVSVLAVAACGGLFAALLKQPVLLGYLIGGMVVGPAGLGLIKEVIQVETLAQFGVAFLLFALGVEFSFAELKKVKAIALGGGGLQIALTILTTVLVCGLTGAWGALPAKGVFLGSILSLSSTAVVLKCLMERNETETPHGQVMLGILVVQDLALGLMLAVLPALHEPGEVIGMAVLTALVRIGLFAAGAVAAGIWVIPPLLRLLARTESRELFLLGVVALCLGIALLTESLGLSIEMGAFVAGLMISEVEYADQTLTYVEPLRDIFASLFFAAIGMLIDPVFLLQNIELILGLVALVFLGKFLIITPLVKLFRYPLKTALIAGLGLAQIGEFSFVLASEGQALGLVSRRIYLLILGTTAVTLMLTPFVLRLLPSLFNFAESIPWLKPYISGEGQALDISEDLPFQDHIVVCGYGRVGKNLVKLLQQHNVPVVVIDQSESRIQQLRDGEIPYVYGNCVSLHVLETAGVSHAKGMAIALPDPMSTRLCVKRALELCPELDLVVRATQDKNIELLYQLGAREVVQPEFEASIEMATHLLTDVGWTSGLLQQEMQQIRSDHYLDFRPERNADEVSRHLQQATQDLNRRWYDLPVDSPLIGMNLEEADMRYLTGVSLMAIRRANGEEIDYPNNQTKLAAGDRLLIVGANEELAALEEFAQGKVAVPGQNSACQWVAVDGNSAVLGKTLKDLPLDLQSGIKVQAMRRDGKFIRSPHDNIDLRTGDQVLLCGSLSSLNQIQPLFAVVSEIPLAIPLVKAKETEVVKEMRG

SEQ ID NO: 19391 - protein, 396 aa, Pseudendoclonium akinetum
MAIQNAIKPTTTRPFTLNFGPQHPAAHGVLRLILSMRGEQVLSTDTHIGLLHRGTEKLIEYKTVLQALPYFDRLDYVSVMSMEHSYCLAVERLTEMEVPRRAQFIRMLFAEITRVLNHLLAVTCFAMDTGALTPFLFAFEEREKLMEFYERVSGARMHSAYFRPGGVATDLPAGLLQDIHVWADQFASRIDEIEELLTGNRIFKQRLVNIGVLKAEDAIAWGVSGVLLRGSGIAYDLRKAQSYDAYDQVQFNVPVGTNSDCYDRYLLRIEEMRESLSIIKQTLDLVPTGPIKPADGPVASRAEFKSDMESLIRHFKASTSGFAVPVGETYCSSEAPKGEFGVLFVSNGANRPYRVKIKSPDYASLQAIDILGKGHYIADVVAIIGSLDVVFGSIDR

SEQ ID NO: 19392 - protein, 303 aa, Blumeria graminis
MKNLLAESLIEAICAKTKELLMQESNVVHIQAPVTVVGDIHGQFYDLIEIFKIGGFCPDTNYLFLGDYVDRGMFSVETISLLVCLKLRYPHRVHLIRGNHESRGVTQSYGFYTECSRKYGNANVWHFFTDMFDFLTLSVVINDQIFCVHGGLSPSIHSIDQIKVIDRYREIPHEGPMADLVWSDPDPERDEFSLSPRGAGYTFGAEVVKKFLAVNNMTHILRAHQLCQEGYQVLYDDRLSTVWSAPNYCYRCGNMASVLEVSDLGERFFNVFAAAPENDFLKGDLHNGTEKVSDGNSLPDYFL

SEQ ID NO: 19393 - protein, 478 aa, Xanthomonas campestris pv. campestris str. ATCC 33913
MRGRMGRHRSGPRMSEPSSTDAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCVLIFSLNMVSARWFAEGEFWFSLINVVTIVVFIVLGGAAVVGWLPLADGSPAPGVRHLRADGWFAHGTVPILMTMVAVNFAFSGTELIGIAAGETAQPARAIPLAIRTTLIRLVVLFVGTVLVLAALLPAHAAAVETSPFVRAFELLGIPYAAGLLNAVILTAILSAANSGLYAAARMLWSLANEGTLPARFARLTRRGIPLPALVLSMLGGLLALLTGVYAADTVFVAISAVSGFAVVVVWLSICASHYCFRRQLLRDGIALDSLAYRAPWYPWTPLIGGALCVLACAGLAFDPQQRIALWCGIPFVALCYGAHAVTQRLAARRVRP

SEQ ID NO: 19394 - protein, 455 aa, Prochlorococcus marinus subsp. pastoris str. CCMP1986
MYPLVAELSAHDLEVAETLIGVIRFLLIFLAARALAEVLVRLSLPTIVGELLAGVVIGASGFHLLIPPSAHTELNQGLVNVISSLASIPPEVVPDVYFESFPSLQAVATLGLYALLFLTGLESELEELVAVGAQAFTVAMAGVILPFAFGTFGLMFIFQVDLIPAVFAGASMTATSIGITASVFGELGYLKTREGQIVIGAAVLDDILGIVILAVVVALAAGGSLEIAPIVKLVAAAVVFVIAAIALSRTAAPGFDWLLDRLKAPGAVVVASFVILVLCCFVATAIGLEAALGAFAAGLILSSSKNNHAIQQSVLPLVSLFATIFFVLVGAGMDLSVINPLDPASRSALVVAGFLLVVAIIGKIAAGWVFSSDKPTNRLVVGLGMMPRGEVGLIFLGLGTSAKLLTPSLEAAILLMVIGTTFLAPVLLRIVLKDKPPGGDNKISDDVAADPVGLL

SEQ ID NO: 19395 - protein, 848 aa, Prochlorococcus marinus subsp. pastoris str. CCMP1986
MSNLMNSNEPFDLRLPTPGCYLDPEKAGMDSDALFKGMTEHLFFTLGKLATSASPHDLYMALSYAVKDRLMTRYLASQEVIRKKPQKTVAYLSAEFLIGPQLSNNLLNLGITKEAEDALKRFGIESLSTILEVEEEPGLGNGGLGRLAACYMESLASLQVPAVGYGIRYEFGIFNQLIRDGWQVEVTDKWLKGGWPWELPQPDESCFVGFGGRTESYRDDKGKYRSRWVPSEHAIGVPHDVPVLGYRVNTCDRLRLWRADATESFDFYAFNIGDYYGAVEEKVASETLSKVLYPNDGTDEGRRLRLKQQHFFVSCSLQDMLRSLEKRSIPVTEFANHWTVQLNDTHPAIAVAELMRLLIDQYQIGWDKAWNITTSSVAYTNHTLLPEALEKWDLSLFSDLLPRHLEIIYEINWRFLQQLRLRYPGDDKILQKLSIIDEEGSKSVRMAHLATIGAHHINGVAALHSDLIKRQLLPEFAELWPEKFTNVTNGVTPRRWVALANPSLSNLLEKEVGPDWITNMELLKKLENKKDDANFLQEFEETKLRGKRKLASFIHTKTGILVDPSSLFDVQVKRIHQYKRQHLNALQIIAQYLRIKNGTSNYKAPRTVIFGGKAAPGYFMAKLIIRFINGIADVVNSDPDMEGLLRVVFLPDYNVKLGEIVYPATDLSEQISTAGKEASGTGNMKFAMNGALTIGTLDGANVELRDLVKKENFFLFGKTESEIMHLKNNSYSPKTFIEKCPELQEVIRLIEIGHFSNGDKELFKPLLNSLTGNDPFFVMADFEDYLNKQDEVSNFWNNKKAWNKMALLNTARSGYFSSDRSIREYCESIWKVSPMPVEITCDIEEITT

SEQ ID NO: 19396 - protein, 212 aa, Arabidopsis thaliana
NTRPPTRPPTRPPTRPPTRPEDDRRVRLREDDRRGEIDAELTIVMSSISLACKQIASLVQRAGISNLTGVQGAVNIQGEDQKKLDVISNEVFSNCLRSSGRTGIIASEEEDVPVAVEESYSGNYVVVFDPLDGSSNIDAAVSTGSIFGIYSPNDECIVDDSDDISALGSEEQRCIVNVCQPGNNLLAAGYCMYSSSVIFGLTLGKGVFSFTL

SEQ ID NO: 19397 - protein, 495 aa, Oryza sativa
MAEVALFRGPTNLASPASRSSSSSSSSSLRYLATSDGDVLPRRSSSGSGSSLGSTGSLGIQERREEEGGESEEEEEEWSFLALLLALLRKSLLGCSAEDGGGGEGMEIGWPTDVQHVAHVTFDRFHGFLGLPVEFEPEVPRRAPSASASVFGVSTESMQCSYDSRGNSVPTILLMMQRRLYEQGGLRAEGIFRINAENSQEELVRDQLNGGIVPEGIDVHCLAGLIKAWFRELPSGVLDSIPPEQVMQCQSEEDCARVAKCLPPTEAALLDWAVNLMADVVQEEQINKMNARNIAMVFAPNMTQMADPLTALMYAVQVMNFLKMLIQKTLKDREESDLDDLSLPQKDPSDENGHQTTGLSLDSHPDEGSRRPSFVSEEPLLNSPVHSTEEKPNKTNLAEGKFADSSCPENVALTSMETEGSTSCSQPALAAAAAAPRATAMNLLQGKGSRSLNSRRTRKGKVQFGTRAAPASEKSKGASIVSRINSKVERIEAWR

SEQ ID NO: 19398 - protein, 187 aa, uncultured archaeon GZfos37B2
MAQMVNKHDVKKRMRQLAAEYIHEPQQEAYKLDDTEMMLHIGPQNPIQPGPFLIDLKISGETVRDSKLYMGYGHKGIEKILESMTYIQGLPVTDRICYLASLSNNEAYVSSVERLLDIEPPERSQYIRVIMQELSRIQSHLLGTGEYATDLGFVTMFLFMIREREYVLGLIEDITGARITHCFPRFG

SEQ ID NO: 19399 - protein, 568 aa, Photorhabdus luminescens subsp. laumondii TTO1
MEHSTPLITTLVGGFFIAYLLGMLAQRLKISPLVGYLTAGVLAGPFTPGFVADASLAPELAEIGVILLMFGVGLHFSLKDLLAVKSIAIPGAIAQILVATLLGVGLSAILGWELFSGIVFGLCLSTASTVVLLRALEERQLIDSQRGQIAIGWLIVEDLAMVLTLVLLPAAAGILGNKEANIGQLIMELAMTVGKVIAFILLMIVVGRRLIPWVLAKTASTGSRELFTLAVLVIALGIAYGAVALFDASFALGAFFAGMVLNESELSHRAAQDTLPLRDAFAVLFFVSVGMLFDPMVLIQQPLSILATLAIIIIGKSAAAMLLVKMFGHSRRTALTISVSLAQIGEFAFILAGLGVALGLLDGNARNLVLAGAIVSIMLNPVLFSLLDRYLEKTETIEEQLLEETLEEETQIPVDICGHTIVVGYGRVGSLLCQRLQEKEIPLVVIENTRAKFEELGEQGISAVMGNAASKDIMSLARLDCACSLLLTIPNGYEAGEIVACAREARPDINIIVRADYDDEVTYITERGASHVIIGEHEIAKTMATVFANSEQSYSIEPPPASPFSPSL

SEQ ID NO: 19400 - protein, 420 aa, Arabidopsis thaliana
  misc_feature (20)..(20): Xaa can be any naturally occurring amino acid
  misc_feature (153)..(153): Xaa can be any naturally occurring amino acid
  misc_feature (168)..(168): Xaa can be any naturally occurring amino acid
  unsure (1)..(420): unsure at all Xaa locations
MRKKKTRFQFLLNPNSKFVXFFPRAISSSSSSSSDNNNDGSVSSSRQNNRQMGYDPSEELFGVDFKPRFISGDSREPRSWFGPNGQYIRELPCPTCRGRGYTSCSNCGIERSRLDCPQCKGKGIMTCLRCLGDCVIWEESIDERPWERARSRXCCYSRVEVLILFNVXLINLIFFCHSSPFRVKEDDEVDNLEIKFSKRRKSKRIYQSPTPEVGQKISRSLKSLNAKTGLFSKRMKIIHRDPVLHAQRVAAIKKAKGTPAARKHASESMKAFFSNPVNREQRSLSMKGTKFYCKNCGQEGHRRHYCPELGTNADRKFRCRGCGGKGHNRRTCPKSKSIVTKGISTRYHKCGICGERGHNSRTCRKPTGVNPSCSGENSGEDGVGKITYACGFCKKMGHNVRTCPSKQVSDSDSCLEQEGS

SEQ ID NO: 19401 - protein, 344 aa, Mannheimia succiniciproducens MBEL55E
MMKSAVVFTALFLYAISHIKDELYLPKQGAFMKIVFLDSTALPPHLPIPRPDFDHEWIDYPYTGAEQTVERAKDADIVVTSKVIFSREVMEQLPKLKLIALTATGTNNIDLIAAKELGIRVKNVAGYSSVTVPEHVLGLIFSLKHSLAGWYRDQLEGKWGESKQFCYFDYPITDIRGSVLGVVGKGCLGTEVGRLATALGMKVLYAEHRDAQSCREGYTPFDEVLKQADIVTLHCPLTEHTTNLINKETLSLFKKGAFLINTGRGPLVDEQALLDALKSGHLAGAAIDVMIKEPPEKDNPLIVAAKTMPNLLITPHIAWASDSAVTTLVNKVRDNIEEFVATGK

SEQ ID NO: 19402 - protein, 1046 aa, Debaryomyces hansenii CBS767
MARFTFGKNKKRLEEANTSYADDTMDSSSPSEPVHDSPVSSPVASPILRKQPKLRIAPAITINGTTPWKRHKLINSPFPRYRHSAAAVATEKNEIFLMGGLKEGSVFGDTWKITPQGLTLDDEITGYEASNIDVVNLNNPPARVGHSSVLCGNAYIIYGGDTVDTDFNGFPDNNFYLFNINNSKYTIPSHVLNKPNGRYGHTIGVISLHNTSSKLFLFGGQLENDVFNDLYFFELNTFKSPKARWELIEPLNNFKPPPLTNHSLSVYKNKIYVFGGVYNNEKISNDLWCFDALISKWIQVTTTGNVPPPVNEHASCIVNDKLFVYGGNDFSGIIYNSLYVLDLHTLVWSKLIEQGENNGPGPRCGHSMTYLPKFNRLLIMGGDKNDYATSNSDDFETYELYNGEEYGTMIYELDLDIVEHFLSSSAAAKTAAKSPSKKMAASAAPIAPVVGNDDSRNNLLRHARSYSAGPDDFKTPNVSPERVPRIVTDSEPQSKQANSQPEDKFVDVDVPSGNISERDISIDDQRDFVPSDDEIPPISQRRSRGILGNNSGQAANGTRPKVLGKDYNYIRSDEDLTRSNNATPVLERNSQIPPSAVARNGEDDSKIKKLVNELTNELNDLRASTKTQMQNATEKINSLEQENASLRENDKSTNLQGQLQDKEALLGEKDNLIYELKRQVDPAALAINEDESSERAISTGGISELSKYKLERLELNNRLIYLEDENAGLTAKFADFEPFMNNQIGQLSSFQKIIKAQEEKISRLSSQVKDQEPLHREINDWKNKFHNLQLEFDNFKTINADDQFSDSDNERFAEEQGAEVNRSIASNASVSKKSKKEIASHLESLIALWSARSASEQKDMSGNVNPNSESSAMVSKLQMQLDDLLKISKQQEMGSSNEIQSLKNELNIKLQNLKTFEENYRDALQSVNNTSKALNLTQDELNNQRIMMEKLIKENNELKLFRRASRRVSARTPIINEEQFGDSNVASPTISETSPHDDDAAISNAHYNMKVKDLEADLYILKQERDQLKDNVTSLQKELYLSQNTQ

SEQ ID NO: 19403 - protein, 89 aa, Arabidopsis thaliana
  misc_feature (22)..(22): Xaa can be any naturally occurring amino acid
  misc_feature (37)..(37): Xaa can be any naturally occurring amino acid
  misc_feature (42)..(42): Xaa can be any naturally occurring amino acid
  misc_feature (57)..(57): Xaa can be any naturally occurring amino acid
  misc_feature (62)..(62): Xaa can be any naturally occurring amino acid
  misc_feature (66)..(66): Xaa can be any naturally occurring amino acid
  misc_feature (73)..(73): Xaa can be any naturally occurring amino acid
  misc_feature (75)..(75): Xaa can be any naturally occurring amino acid
  misc_feature (77)..(77): Xaa can be any naturally occurring amino acid
  misc_feature (85)..(85): Xaa can be any naturally occurring amino acid
  unsure (1)..(89): unsure at all Xaa locations
MASSMLSSAAVVTSPAQATMVXPFTGLKSSAAFPVTXMTNKXITSIASNGGRVSCMXVWPPXGKKXFETLSYXPXDXSDVELAKXVDYP

SEQ ID NO: 19404 - protein, 209 aa, Bacillus thuringiensis serovar konkukian str. 97-27
MKRVGKEFFLQHDIVIMYSILFVFIIILKIQFFTWIGLLSCLFGIIFYTLNEYMTHRFLFHLKPPKNVFLLKMLRRLHYDHHVYPDDLKLLFLPVWFSIPSFTIYLFISYAITKSVTITLSFGIGMIIMLLVYEWKHYIAHKPIRPVTKFGRWLKKQHILHHYKNEKFWFGVSNPVFDFIFGTLKDGKDVELSETARNLEKEKETKVVR

SEQ ID NO: 19405 - protein, 680 aa, Zea mays
  misc_feature (179)..(179): Xaa can be any naturally occurring amino acid
  unsure (1)..(680): unsure at all Xaa locations
MDRDEEMGHGDRSLLFVGDEDDDIGTYRDGGFMETSSDEGSFSDPSDGEARGGRRGGDGSKSAWPQSYRFVNQSPRPRPHLRVYDGCTRSQCRSRRDYSELTAALSSSRRQSIDMLSVVPSPTVSMLMAASPNLTRFGSSFLKAGSSFFLRKGDDSVLPLARPLLPPSLPQLSQSSLRXQPPMRQSTDILAQPPRPPAGHEAQLPDRPSSACLRPDYIELPPPASKCSRNQSIINGFNVLCGVGILSTSYGIKEGGWSSLLLLPLLGGSSCYTGLLLKRCIDSSPNIGTYPDIGQAAFGVAGRIFVSVVLYLELYASCVEYITLLGDSMSSVFPSAHLAFAGIDMNAHTLFAITTALAILPTVCLRNLSLLSYLSVIVCLFWVGIGEGIGFHFSGALVNVTHLPVALGLYGFCYSGHSVFPNIYSSMKERSQFPFVLLFCFTVVTVAYAGIAVSGFLMFGESTMSQFTLNLPQQYIPSKIAIWMTIVNPYTKYALTMTPVALSIEEALPKKMQNYLVGMSVRTCLVLSTVVVALLFPYFGLVMALLGSVFTMLVALILPCACYLSIKKGAVPLWEIILCIVIIMIGAKFGSWNTDGGGGRPAETAAALCPQELCCSVAAIHREKNTVEAAAAAGLQPQQAAANKLQNLEHYGIYYFLPNASLFCSHPQGPVRLFRIGALD

SEQ ID NO: 19406 - protein, 328 aa, Silicibacter pomeroyi DSS-3
MKTYDVVGIGNAVVDVISQADDSFLDLMGIEKGIMQLIEQERGEVLYASMKERVQTPGGSVANTIAGAGALGLDTAFIGRVRDDALGHFYADAMNEGGIDFVNPPVAGELATSRSMIFVSPDGERSMNTYLGISTTLSSADVPQEVTGNAKLMFLEGYLFDHDAGKSAFREAARATRAAGGKAGIAISDPFCVDRHRADFLSLIQHDLDFVIGNEAEIQSLFETDHLDDALMLTSGICPLVVCTRSGDGVTVMDGTLRIDVPVEKVVPVDATGAGDQFAAGFLFGMATGRDYETCARIGNICAREVISHIGPRPEANMVELLKENGLL

SEQ ID NO: 19407 - protein, 427 aa, Geobacter sulfurreducens PCA
MLTARSKDLFTQAQEFIPGGVNSPVRAFKSVGADPLFIKKAFGCTITDADNNSYIDYVGSWGPMILGHCHPQVVEAVKRAVESGSSFGAPTELEITLARMVIDAVPSIEMVRMVSSGTEATMSAIRLARGYTGRDKIIKFSGCYHGHADALLVKAGSGAATFGVPDSPGVPVDVAKNTLTAQFNDLDSVSKLIDENKNEIACIIVEPIAGNMGTVPPGEGFLEGLRSICDSEGIVLIFDEVMTGFRVAYGGAQELYGVTPDMTTLGKIIGGGLPVGAFGGKKDIMKLLSPSGGVYQAGTLSGNPLAMTAGIETLKLLQADGFYEQLEQTSRRLAEGITEAAKSAGYPIYPTRVGSMFCTFFTSNEVKDWPTATTCDTKAFAAFFRMMLEKGIYLAPSQFETAFVSIAHTEVEIEKTIVAARSCFAAL

SEQ ID NO: 19408 - protein, 323 aa, Aspergillus oryzae
MGIFDYDFLYSQLFIRPAYPTTSFTNQTIIITGSNVGLGLEAARHFTRLGAAKVILAVRNRSAGEEARQSIERSTGTTGICEVWDLDLASHESVLAFAKKVAELPRLDVFIANASIATGTFQLAEGHERTITVNVINTILLELLVLPTLRKSARLHPGTKPRLTTVVSEVHAWAKFAERSAENVFKALDDKEQANMPERYELSKLLQVLLLREMVAQGAGDSVIINMVNPGFCHSRLGREMGLAFALLQMVLARSTEVGSRTLVAGAASGEESHGAYMTNGKVDNGALSTFVRSEEGKKTQMKLWAELVEILEALEPGCTRVV

SEQ ID NO: 19409 - protein, 178 aa, Zea mays
MAGATTPASGALVRLCLPSLLLFLYRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSIRAMCGLDSEKNCVHGSDSPESADREISFFFGEAESVTVEHDEL

SEQ ID NO: 19410 - protein, 292 aa, Candida albicans SC5314
MKTNYGGKFLSNEIQDYLIDTKKVVMEPSFKIKSKIPTTYPDPPKYELKNNNTIPTSSSSSLSQSFLEFQNEKIYHNFKEILEVPEKNSSSGTTTTTTTTNKDSSRLFELPTGQSIVIDRFKIAESIFDPTIYKFTNSKLSFPPNNGEISITQANEYRPLKRVRKNDDDEEEDSNQSTPKPEVNIRGISQLISHTLSNIDIDLRASLANNIIVTGGVSLISQLTERLYLELSNNNPGLKIRLHAVGNSTERINQAWIGGSVLASLGTFHQMWVTKEEYNEVGVDRILNQRFR

SEQ ID NO: 19411 - protein, 457 aa, Yersinia pseudotuberculosis IP 32953
MEQQLQNSSLKRGLKNRHIQLIALGGAIGTGLFLGIAQTINMAGPSVILGYAIGGFIAFLIMRQLGEMVVEEPVAGSFSHFAYKYWGDFAGFLSGWNYWAMFILVGMAELTAVGIYIQYWWPEIPTWVSAAVFFIIINAINLVNVRLYGETEFWFAIIKVAAIIGMIVFGAYLLASGSGGPAASVTNLWAQGGFMPHGFRGLIMAMAVIMFSFGGLEMVGITAAEAEDPRNSIPKATNQVVYRILIFYIGSLTVLLSLFPWNNVVEGGSPFVMIFDALDSPWVATALNVVVLTAALSVYNSGVYCNSRMLFGLASQGNAPKLLTKLNKRGVPIRSIALSALATSAGVVINYIMPGKAFELLMALVVSTLVINWVMICLAHLKFRKAKVKEGVVPRFKALWYPYGNYLCLVFLALILVIMYLTEGIRISVLMMPVWIALLWCGFVLTRRKCPKTVTSL

SEQ ID NO: 19412 - protein, 387 aa, Bacillus thuringiensis serovar konkukian str. 97-27
MEQFINPRVKDIQISGIRQFSNMIQNYDNLISLTIGQPDFPTPSLVKEAAKRAITENYTSYTHNAGLLELRKAACNFVKDNYDLHYSPENETIVTIGASEAIDVAFRTILEPGTEVILPAPIYPGYEPIIRLCGATPIFIDVRETGFRLTAEALENAITEKTRCVVLPYPSNPTGVTLSKKELQDIADVLKDKNIFVLSDEIYSELVYEQTHTSIAHFPEMREKTIVINGLSKSHSMTGWRIGLLFAPSYLAGHILKVHQYNVTCATSIAQYAAIEALTAAKDAPKMMRHQYKKRRDYVYNRLIQMGLTVEKPTGAFYLFPYVGHLTSSSFDFALDLVKEAGLAVVPGTAFSEYGEGYLRLSYAYSIETLKEGCDRLEAFLQKKAKS

SEQ ID NO: 19413 - protein, 143 aa, Candida albicans SC5314
MATASTTTVYGGDEINAIVLDPGSYTTRIGYAGDDFPKVITSSYYGQVKNDKKKIFGESINVPRANYDIKPILKESIIVDWDAAIEQYQYYFDQQLKVVGPEQPILITEPIWTETSYRQQLVETFFENDEFRGIYIAKSPTCA

SEQ ID NO: 19414 - protein, 397 aa, Neorickettsia sennetsu str. Miyayama
MLSKKIESIKPSATAAATRRVCELRARGKDVISLCIGEPDFSTPFLGQEMAIQAIKDCDDNYSPVAGTMVLREEIAAKFVRDNALHYSPHEIVVGNGAKQVLYNVLGAILNPEDEVVLIAPYWVSYCEIVRIFSGKPVVVPSTKKFRIDITAIREALNTKTKAILINSPNNPSGVCYEESELRDLASALRAHPQVHIISDDIYEHITYAESSFLNIANVAPELGERIILVNGVSKCYAMTGWRVGYAAIPNKAVISLVCRLQEHSTFGVCTIAQAAALGALRSGADVLSERLAVFARKRNKAVEVLSMLPELCCYKPDGGFYLFLSCSAFFGKKSPSGFEVKTDSDVADYLLEEHAVAVVPGEEFGVPGYFRISYALSMDLLEQACMRIVKAFKALR

SEQ ID NO: 19415 - protein, 492 aa, Mycobacterium avium subsp. paratuberculosis K-10
MTATISTPQYLLDQARRRFTPTLNTIPGMGAIEKRLLAHEWQTKVLAEPPAGSGLKPVLGDAGLPILGHIIELFRGGPDYALFLYRNHGPLIYLDSPIMPAVTALGPDATQAVFSNRNKDYSQKGWHPVIGPFFNRGLMMLDFDEHMYHRRIMQEAFTRSRLTGYVEHIDRVATAIVADWPTNDARFLFHPAMKELTLDIASLVFMGHEPGTDHDLVTTVNQAFTTTTRAGGAIIRQPIPPFKWWRGLRARQLLEDYFSERVKERRNATGNDMLTVLCHTEDDDGNSFTDDDIVNHMIFLMMAAHDTSTSTTTTMVYNMAAHPEWQERAREESARLGDGPLDIEALEKLETLELIMNESLRMVTPLPFNMRQAVRDTELLGHYIPAGTNITIWPGMNHRLPELWTDPDKFDPERFAEPRAEHKKHRYAFAPFGGGAHKCIGMVFGQLEVKTVVHRLLRRYRLELARPGYQPRWDYGGMPIPMDGMPIVLRPL

SEQ ID NO: 19416 - protein, 374 aa, Corynebacterium glutamicum
MKIDAYVVEEINAPLVRETLTIDDPGPGEVLVKVVATGVCHTDLNTQSGDMPLPLPGVLGHEGSGVVEAVGAGVTEVEPGDHVIMGWPYCGTCRNCVRGEHRYCLNIGAELLAGVRLHGPDAGSSAYTRADGTALSGHFFGQSSFATYSLTRANAVVKVDKDIDLALLGPLACGITTGAGAVFNTAQPGPGESIVIIGAGAVGLAAVMAARNTPAATIIAMDLQDSRLELARELGATHTVNTREKDIVEAVTEICGGPADYVLDCTGSIKVIEQAADAVGLMGTFILVGGAPAEARFSLDHMRTLFGKTVVGTLGGSSNSRTLIPGLINLYRQGRFPFDKLITTYGFDELDQAIHDAHEGGTIKAVLRVDKTNQ

SEQ ID NO: 19417 - protein, 493 aa, Corynebacterium glutamicum
MTVTTPTTYSAIVADQLYIGGWREGTSERIATTTNPFNDETIATIRQASPDDVDAAYEIAKESQAVWAALAPKERVHILTKAADWIEENQEAVIELIRVESGSTAIKATIETSLAVGSLREAATFPTRITGQILPSNTPGKANYVFREALGVVGVISPWNFPFALSMRSVAPALACGNAVVVKPASDTPLTGGLLLGKIFEAAGLPEGVLNIVVGSGSEIGDHFVEHPIPRLISFTGSTPVGKQVGATATGGKHIKKVALELGGNAPLVVLEDADLDQAVGAAAMGKFLHQGQICMAVNRIIVQAPLYDEFVEAFAKRVQTLAYGDQCDDATVVGPVINDSQLHSVTKKIERARIEGAREVVSGPIEGRVIAPHVFADVTPAMELFREEIFGPVVGIIKAKDEAHALELANDTEFGLSSAVYTRDLARGLNFARQVEAGMTHVNDITVNDEAHVMFGGEKNSGLGRFNGEWAIEEFTTTHWVGVAPGQAQFPF

SEQ ID NO: 19418 - protein, 350 aa, Zea mays
  misc_feature (28)..(28): Xaa can be any naturally occurring amino acid
  misc_feature (122)..(122): Xaa can be any naturally occurring amino acid
  misc_feature (322)..(322): Xaa can be any naturally occurring amino acid
  misc_feature (337)..(337): Xaa can be any naturally occurring amino acid
  unsure (1)..(350): unsure at all Xaa locations
DSMKHEPPGDSHDDEASTRRPIALEGLXRQFNTHKAVSLPSPPNMTRILGLRSPSDYTQPHLMATCNEVVHTSPFLNQPLLPYDEWRIEFSKITVGIRVGAGVFGEVLRGLRNGTDVAIIGXLEQDLTTENMNYLSLEISILSRLPHPNVILFLGASMKPPHLSLVTEDMEEGSLYSLIHSKTHNTKLHGNTRVQMLRDICMRLMCMHRLEIVHRDLKSAHRLVNIYWTVKICDFGLSRVMSNSAMTVNSSAGTPEWMAPHLIRNEPFTEKCDIFSFGVIMWELCTLCRPWEGIPPVQIVYSVANDGARLEIPDGPLVSLIXDCWAQPERRPSRQEXIMSRLLVCEYTLC

SEQ ID NO: 19419 - protein, 231 aa, Burkholderia sp. 383
MTQDELKRLVGQAAADYVIQNVPEGAVIGVGTGSTANCFIDALAVVKARYRGAVSSSVATTERLKSHGIKVFDLNEVDSLQVYVDGADEIDASGAMIKGGGGALTREKIVASVADTFVCIADASKRVPVLGAFPLPIEVVPMARTAIGRRVTALGGVPVLRVTKDGAPYITDNGNEIIDVKGLQIADPRGFEAQVNAWPGVVTVGLFAERGANLCLLGTENGVETIVYSAN

SEQ ID NO: 19420 - protein, 499 aa, Hordeum vulgare subsp. vulgare
MGEGAWWAVAAVVAALAVVALDAAVRAAHAWYWTASLGAGRRGRLPPGDMGWPLVGGMWAFLRAFKSGRPDSFIDSFARRFGRAGLYRAFMFSSPTIMATTPEACKQVLMDDDAFVTGWPKATVALIGPKSFVNMGYDEHRRLRKLTAAPINGFDALTSYLGFIDDTVVTTLRGWSERGGDGHFEFLTELRRMTFRIIVQIFMGGADERTAAELERTYTELNYGMRAMAIDLPGFAYHKAIRARRRLVAALQRVLDERRARGGKTAAGAAAPVDMMDRLIAVEDEGGRRLQDDEIIDVLVMYLNAGHESSGHITMWATVFLQENPEILAKAKAEQEAIMRSIPPGQKGLTLRDFRKMAYLSQVVDETLRFVNISFVSFRQATRDVFVNGYLIPKGWKVQLWYRSVHMDPQVYPDPKKFDPSRWEGPPPRAGTFLPFGLGTRLCPGNDLAKLEISVFLHHFLLGYKLTRKNPNCRVRYLPHPRPVDNCLAKITRLSSSHG

SEQ ID NO: 19421 - protein, 123 aa, Triticum aestivum
  misc_feature (12)..(12): Xaa can be any naturally occurring amino acid
  unsure (1)..(123): unsure at all Xaa locations
NDVLAATACQFXNFVAIVDPPRAGLHPTVIKVLRTHPRIRRLVYISCNPDTLVANAIELCTPSTEHREKNKGPRGWRNMSSAGLARQRTKSMPNSEPFVPKRAMAVDLFPHTSHCEMVMLFER

SEQ ID NO: 19422 - protein, 86 aa, Glycine max
MSSGIRAWSVAASVGVVEALKDQGICRWNHALRSAQHHLKNHVGSFSQANKLSSSAMISTTLKHEKAKQSEESFRTVMYLSCWGPN

SEQ ID NO: 19423 - protein, 514 aa, Escherichia coli O157:H7 EDL933
MSVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTAVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVAGGKLSDIAPTMLSLMGMEIPQEMTGKPLFIVE

SEQ ID NO: 19424 - protein, 501 aa, Kluyveromyces lactis NRRL Y-1140
MNFKLNWVTLFCTALWLHFATANKGTITEKQNQICSGMYSKEDWSGRVDPYISFDLKKLNKEGISVVIFDFQDYIHIGAKTKAGVVKYICDEEAIKENLCQEKNKNQFIISPEAYDPDSDTEKSLSADIHTFYVGNTGLVKDKYAIKKTGYYCVGTYAKDTGISYKAEVNFRNSFGNLAASEINKLPLYGLLAIFYVVAMALYLFAFWKHKHELLPLQKYLLAAFVFLTIDTIFIWGYYDLKNTKGSTAGTTVYMVIVSILNSAKITMSLFLLLVICKGYGVVYPKLNKTTMRRVQFFSVLTFAISVAALIQNYMTPSDSTSMVPLFFFIPLGICFMIFYFLILQSLDQTVKYLKQQKQIVKLGMYKKLIIIFYVALFVIFGGIILSSFVLIGMSSIEMVEQHWRTRFFFVDFWPSLVYYAVFVALSFTWRPTSTSYMLAVSQQLPTDPENVADFDLDDLQSLEQEWNQEYEQPAGSEPNEADLNFSDDENDKKKPVQPSA

SEQ ID NO: 19425 - protein, 196 aa, Triticum aestivum
AYLGDTIEQVCTKKQAGTGPEFPGYRRPTRPWSMESGEHMPNKQKFVSELARVAAPGATIIIVTWCHRNLAPSEDSLKPDELNLLKKICDAYYLPDWCSPSDYVKIAESLSLEDIKTADWSENVAPFWPAVIQSALTWKGLTSLLRSGWKTIKGALVMPLMIQGYKKGLIKVSIITCRKPQAAIEGEPEAASPSVE

SEQ ID NO: 19426 - protein, 202 aa, Zea mays
DLEKEHARGRQTLNKMNARVVQLEEQVHEFELQHMQQTQAEVSQVEDSIRELQQEINSAHLNATRLSEKEKKSSEELRAIIKNIGDIGKEIEEDGRRINQLRSQIDDIRRRQQNKLTAFGGDRVPSLYKSVERHMSKFKCPPIGPIGYHLQLASDSWSVAIEYALGRLLDAFIVSCHKDSLVLRECAKEVNYRNLQIIIYDF

SEQ ID NO: 19427 - protein, 276 aa, Desulfitobacterium hafniense Y51
MNIQWFPGHMAKAKRLLLEQLRWVDVVIELGDARLPESSRNPLLQEMLGDKPKIIILNKVDLADPYWTEIWTRKLRQANPVLAVSATNGAGVGKIVPEVERLMAHKIEKWTAKGIRARSIRVMIVGIPNCGKSSLVNNLIGSAKAKTGNKPGVTRGNQWIRIHERVELLDTPGLLWPKFEDPEVGKKLGAVGAIRDEVLNLEELSLWVLEQLKENYPEALTRYTEDVQNLDLEGIGRKRGCLVKGGQVDILKAAQIFLREFRAGSLGKFTLDHTVK

SEQ ID NO: 19428 - protein, 607 aa, Debaryomyces hansenii CBS767
MSVYTPNSAAVAAQQQQQQHQQRQQHQQRLSELLEAVKQEFDFALNEASNFKQVKEDYDLKYNQQTAEMQQIRQTVYELEMAHRKIKEAYEEEILRLKTELENRDRQAQQHQNKLNGIENRQPPFGNYPPPQQQQPPQQAPVPQVSQSQTLPPPIKPSPAKQEAKLESPKTAKVEPTKDETASTQPPAEPSTPETSTALTIIDKSQYIVNPLQKASHVKEIPSFLADLDVSKANPDFKKQKPDYYVLYNPAFNRDLDVDLIHSLDHSSVVCCVRFSKNGEFIATGCNKTTQVFNVKTGELIAKLIDDNSSNGINDDSNNENQSGESNVQSSSANANGDLYIRSVCFSPDGKLLATGAEDKLIRIWDLETKRIIKILRGHEQDIYSLDFFPDGNRLVSGSGDRTVRIWDLRSSQCSLTLSIEDGVTTVAVSPDGQLITAGSLDRTVRVWDSTTGFLVERLDSGNESGNGHEDSVYSVAFSTNGKQIASGSLDRTVKLWNLEGKQDPQSNVSNNASTGKKSSCDVTYIGHKDFVLSVCSTPKNEYILSGSKDRGVIFWDQLSGNPLLMLQGHRNSVISVAVSLNSQGTEGIFATGSGDCKARLWKWTRK

SEQ ID NO: 19429 - protein, 531 aa, Zea mays
MQGASHMLLEEPFRLASVLSPAKPKVFPSLTKIVGTLGPNSHSVEIIQECLTAGMSVARFDFSWMDAAYHQETLDNLRKAAQNVKKLCPARVETQQKPQVKVQVMLDTLGPEIQVHNSTGEPIELKAGNHVIITPDICKALSAEILPIKFGDLAKAVKKGDTLFMGQYLFTGSETTSVWLEVVETSGENVNCLVKNAATLDGPIFTLHASQVHINLPTLSEYDKHVISTWGSCNSVDIISLSHTRSAEDVRELRAFLQAHALPDTQIYAKIENSEGLDHFDDILNAADGIIISRGDLGIDLPPENVFMFQKTAIHKCNLEGKPVIITRVVDSMIDNLRPTRAEATDVANAVLDGTDGILLGAETLRGLYPVDAAETVYNQPLQFKKVMWHVGDPMPHEESVASAAVGSAIKVKAAAIVVFTFSGRAARLVAKYRPTMPILAVIFPREGSDPSKWRSYGTTQARQCFAVRGVYPLMGSTDEAETGGLTKEEYGIKLAMSYGRSVGIVKPFDRVIIFEKIGDSSVVKIIECEG

SEQ ID NO: 19430 - protein, 263 aa, Zea mays
PVKSPVTICGDIHGQFHDLLELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIENLDNVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHTFIQFEPAPRRGEPDVTRRTPDYFL

SEQ ID NO: 19431 - protein, 235 aa, Mesorhizobium sp. BNC1
MTDAKTLKIEAARVALGYVEDGMKLGIGTGSTAEEFVRLLATRVSSGMKIVGVPTSERTAALCRELSVPLSTLDETPELDLTVDGADEVGPDLTLIKGGGGALLREKIVAAASRRMIVIADESKVVDVLGTFPLPIEVNPFGLRATRIAIEAAAARLGLAGEMRTRMAGQEPFVTDGGHFIIDASFGRIQAPRALAEALNAIPGVVEHGLFIGLAGAAIIAGRNGVRTLDAGSRI

SEQ ID NO: 19432 - protein, 534 aa, Glycine max
  misc_feature (346)..(346): Xaa can be any naturally occurring amino acid
  misc_feature (376)..(376): Xaa can be any naturally occurring amino acid
  misc_feature (430)..(430): Xaa can be any naturally occurring amino acid
  misc_feature (473)..(473): Xaa can be any naturally occurring amino acid
  unsure (1)..(534): unsure at all Xaa locations
GSRTNSLISGDNKGAAARFMEDWFERKGSVRMDLVRFENDGVPRRISNIIPSLHDNYHELLELAASFRSPLGKPATKTSSIARRVRGVLRQVDKPRFVSAFCQTNCGDVSPNVLGAFCIDTGLPCDFNHSTCGGKNELCYSRGPGYPDEFESTRIIGERQFRKAVDLFNAADEEIEGDVDFRHAYIDFSQLEVTISDQGYSEVVKTCAAAMGFAFAAGTTDGPGAFDFQQGDDKGNPFWKLVRDMLKTPSREQIDCQHPKPILLDTGEMKKPYDWAPSILPIHILQIGQLIILTAPRQFTTMAGRRLPDAANTVLSIEEYSESDDILFAIPRPTNTYSQHITTYQXYQEQRYEGASTLYGPHTLSAYIHESKKLAXALVYGKATQPAPQPPDLLEKQISLLPPVVADATPLGVNFGDVCADVPRNSTLQXGDMGTASVWSARPRNDLMTEGPFALAKFLQEKDAWIPAYDDDXCLRYKWSRPSKLSFRSKGPLEWMIPQGVTPGVYRLSHFGAAKGLFGSIHPFTGSSPAFVVA

SEQ ID NO: 19433 - protein, 169 aa, Brassica napus
MKMGMGLVVLTVFMAVMSSTRVLAQSTCTSALISMSPCLNYITGNATSPSQQCCSQLGNVVRSSPDCLCQVLNGGGSQLGINVNQTQALALPRACNVQTPPVSRCNNGGGSTADSPADSPNSSGPGNGSKTVPVGEGEGPSSDGSSIKFSYPLLAFLSVASYMAILMKY

SEQ ID NO: 19434 - protein, 82 aa, Arabidopsis thaliana
  misc_feature (70)..(70): Xaa can be any naturally occurring amino acid
  unsure (1)..(82): unsure at all Xaa locations
KSSAAFPVTRKTNKDITSIASNGGRSSCMKVWPPIGKKKVETLSYLPDLSDVELLKKVTTFSANRWIPCXEIRVKARIVYRE

SEQ ID NO: 19435 - protein, 526 aa, Candida albicans SC5314
MRVKKPTSKRTTTRMREGIKKKAAAKRRKDKKIAKKDVTWKSRKSKDPGIPASFPYKDKIITELEEGRRIEKERREQLKLQKQQERQEALARGEIVEDDDEMDEDDQEEGDGANGLAALLESAQQAAKDYDGEDYEDNENEDMVDSEEDVEYEISDIEDTQDEEFGELEKSRKAYDKIFKTVVDEADVILYVLDARDPESTRSRKVEQAVLQNPGKRLILVLNKVDLIPTHALNQWLNFLKSSFPTVPVKAAPGATNSTSFNKNLTNSMTSDALLKALKSYASKSNLKRSIIVGVIGYPNVGKSSIINALTNRHGNNSKACPVGNQAGVTTSLREVKIDNKLKVLDSPGIVFPDEIVNTKKQSKTQQLAKLALLSAIPPKQIVDPIPAITMLLKKFSKDTEMADGLKNFYQLPPLPSSDLNEFVKHFLIHIARSKGRLGRGGVPNLESAAMSVLNDWRDGRIIGWTLPKASKSAAGVSSEEVDLDAPKSSLRGEKEPPKVEQTTIVSSWAKEFDLDGLLGDNFGLQ

SEQ ID NO: 19436 - protein, 481 aa, Silicibacter pomeroyi DSS-3
MRRLRKVKIVATLGPASETYETIRALHEAGADVFRLNMSHGTHDEIRAKHQIIRQVEQDLDSPIAILADLQGPKLRVGTFVNEAEELAEGAAFRLDLDPAPGDAGRVCLPHPEIFQVLEPGAHLLVNDGKIRLKVLDCGPDFAECTVVTGGTISNRKGVNVPDVVLPLAALSDKDRDDLEFACALGVDWLALSFVQRARDVFEARALADGRAAILSKIEKPAAVEAFDAILDASDGIMVARGDLGVELPVAAVPPIQKRLVRKCRAAAKPVIVATQMLESMIESPMPTRAEVSDVATAIYEGTDAIMLSAESAAGQYPLEAVRTMDNVAVEVEADPTYTQIIAASRTAKGTTIADGIVAAAREIAEKTDIKAICCFTQSGTTALLTARERPGVPIIAMTSLLATARRLCLSWGCHCVITPELERFKGAVVNAARAARAGGFAIETDQIVVTAGVPFNVPGTTNILRVAPCDERLIYNTDPG

SEQ ID NO: 19437 - protein, 434 aa, Cenarchaeum symbiosum
MDLEREYRAKTGGSARIFARSKKYHVGGVSHNIRFYEPYPFVTRSASGKHLVDVDGNKYVDYWMGHWSLILGHAPAPVRSAVEGQLRRGWIHGTVNEQTMNLSEIIRGAVSVAEKTRYVTSGTEAVMYAARLARAHTGRKIIAKADGGWHGYASGLLKSVNWPYDVPESGGLVDEEHSISIPYNDLEGSLDVLGRAGDDLACVIIEPLLGGGGCIPADEDYLRGIQEFVHSRGALLVLDEIVTGFRFRFGCAYAAAGLDPDIVALGKIVGGGFPIGVICGKDEVMEISNTISHAKSDRAYIGGGTFSANPATMTAGAAALGELKKRKGTIYPRINSMGDDARDKLSKIFGNRVSVTGRGSLFMTHFVQDGAGRVSNAADAAACDVELLHRYHLDMITRDGIFFLPGKLGAISAAHSKADLKTMYSASERFAEGL

SEQ ID NO: 19438 - protein, 266 aa, Desulfovibrio vulgaris subsp. vulgaris str. Hildenborough
MPPRAKKSLGQNFLKDRNIAARIAAQLHIGPDDWVIEIGPGPGALTRHIHAAGPARLFLLEKDHHWAREHRLHPLAGTPEAQVVLTDALLFPWERLDAAHPWKVIGNLPYNVASPLMWDICSRAPGLLRASFMIQKEVGERIVAAPGSRQYGALSVWLQCFTKPEWCFVVPPHVFTPRPKVDSAVLAFTPRTDRPDAVQSKRLARVLRLCFQQRRKQLQGILRPHVGGDASALLAGLGIDPAARPETLSPERFIALGEAVAMSAIA

SEQ ID NO: 19439 - protein, 304 aa, Anabaena sp.
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETS

SEQ ID NO: 19440 - protein, 903 aa, Gibberella zeae PH-1
MKGGEYRRRLKWGRGNHLVPIYYTKMFDVVHFSDRSPYVVKRVRIQLSYLEFNRFSFCAFLSHCVIAVAAYRSYMYRTNQHLTVQPPTSVSSCDARTINYITHTLPQSCLTISWTSSTTTSTPSLSNSTSDTSSDPAQSNAPSSSVLSDSQSQPQPSSTATPPKDESQDAAGDGAEKPFMSFEDWKELMLRKTGQDPQDLHARNTKPRDRTPPDMGHAGLGEEDEISLNFDSYLDNAGKQNEPPSDVDQAKGDGSAKAISIHRSKDAGKTCKERFSYSSFDAGATILKTSPGAKNAKAILVENKDSYMLLECSAKSKFVIVELSDDVLIDTVVLANFEFFSSMFRHFTVSVSDRYPVKMDKWKEIGLFEARNSRDIQPFLVPNPQIFSKYVRIEFLTHWGKEFYCPVSLLRIHGSRMLDSWKEADQARDDDSNPEEEAEETQQSLPSGEEAPKIQGAEKNPEPVKTTAMEKMPYCELNATSHVFMVPLFCPVSLNPTTSTTSNQNSSVEVTSAAPTPNSSEDREQKGHSTQHNPRAERPASDEPTSSAFSKTASPSATPAISPTSPSSVSSSNVESVSNFTSQTQSSRTTSTPSSSTNPSIAKPSPANTVNAKKGTTGTASGSPASPTVQEGFFKAISKRLIAVETNLTLSLKYVEDQARHMSETLQRTEQKQISKANLFFEELNRTVVAELRSAREQYDQIWQSTVIALESQREQSNREIVALSSRLNLLADEVVFQKRMAIVQAVLLLSCLLLVIFSRGGSLPYLAPLVDQANLAQYDTGSPAARLRALYGDVYGADGQSAALLAARQRVFVPMTEAADHSDSTELRQRSSLVDEMRNEQAEREQLSPPQTPRSADSFLSSSGRLPSPRETQPSLLRHAPAIHSGNSRKPLPALPENPASP

SEQ ID NO: 19441 - protein, 341 aa, Escherichia coli O157:H7 EDL933
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLASIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMCSGQSGKVILSWD

SEQ ID NO: 19442 - protein, 117 aa, Arabidopsis thaliana
  misc_feature (37)..(37): Xaa can be any naturally occurring amino acid
  misc_feature (68)..(68): Xaa can be any naturally occurring amino acid
  misc_feature (73)..(73): Xaa can be any naturally occurring amino acid
  misc_feature (78)..(78): Xaa can be any naturally occurring amino acid
  unsure (1)..(117): unsure at all Xaa locations
MASSMLSSTAVVTSPAQATMVAPFTGLKSSASFPVTXKANNDITSITSNGGRVSCMKVWPPIGKKKFXTLSYXPDLSXVEFGKEVDYLFRNKWVSLKFVWTGFFTGRENNPGNFLGR

SEQ ID NO: 19443 - protein, 471 aa, Geobacillus kaustophilus HTA426
MNLFRKKPIQLLMKESGAKGASLRKELGAFDLTMLGIGAIIGTGIFVLTGVAAAEHAGPALVLSFILSGLACVFAALCYAEFASTVPVSGSAYTYSYATFGELIAWILGWDLILEYGVASSAVAVGWSGYFQGLLSGFGIELPKALTSAYDPAKGTFIDLPAIIIVLFITFLLNLGAKKSARFNAVIVAIKVAVVLLFLAVGVWYVKPENWTPFMPYGFSGVATGAATVFFAYIGFDAVSTAAEEVRNPQRDMPIGIIVSLLVCTLLYIAVSLVLTGIVPYEQLNVKNPVAFALNYIHQDWVAGFISLGAIAGITTVLLVMMYGQTRLFYAISRDGLLPKVFARISPTRQVPYVNTWLTGAAVAVFAGIIPLNKLAELTNIGTLFAFITVSIGVLVLRKTQPDLKRAFRVPFVPVVPILAVLFCGYLVLQLPAMTWIGFVSWLLIGLVIYFIYGRKHSELNEMARTEEKAG

SEQ ID NO: 19444 - protein, 520 aa, Bacillus sp. WCS10
MKGKKWTALALTLPLAASLSTGVHAETVHKGKSPAADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKDTDLNEKGSWGQQVWHKAPNGEYFYGTFWEGMPDLNYDNPEVRKEMINVGKFWLKQGVDGFRLDAALHIFKGQTPEGAKKNLLWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWETPVYNKGGNGVSVEAQTKQKDSLLNHYREMIRVRQQHEELVKGTLQSISVDSKEVVAYSRTYKGNSISVYHNISNQPVKVSVAAKGKLIFASEKGAKKVKNQLVIPANTSVLIK

SEQ ID NO: 19445 - protein, 316 aa, Solibacter usitatus Ellin6076
MPAIGLGTFGSDHVSAEQIADVVRDAAVVGYRHFDCASVYRNEDRIGFAFRDIMKGGIRREDLWITSKLWNDKHGEGDVIASCRQSLADLQLDYLDMYLVHWPFPNFHPPGCDVSSRSPDARPYIHENYMKTWREMERLVELGLVRHIGTSNVTIPKLKLILRDARIRPAVSEMEMHPHFQQRELFEFVRAAGIEPIAYSPIGSPGRPERDRTPEDTVDIEDPVIVAIAKRIGVHPAVVCVKWAEQLGATPIPFSTRRRNYLANLQGVVSDPLTAADMEAIAGIDRNCRLIKGQVFLWKQDQTWEDLWDLKGVIAQ

SEQ ID NO: 19446 - protein, 196 aa, Triticum aestivum
  misc_feature (37)..(37): Xaa can be any naturally occurring amino acid
  misc_feature (56)..(56): Xaa can be any naturally occurring amino acid
  misc_feature (160)..(160): Xaa can be any naturally occurring amino acid
  misc_feature (175)..(175): Xaa can be any naturally occurring amino acid
  unsure (1)..(196): unsure at all Xaa locations
LLLGTIEQASTAGWYRSVPPGISSTHASAATSVAPFXGLKSTAGLPVSRRSNGASXGSVSNGGRIRCMQVWPIEGIKKFETLSYLPPLSTEALLKQVDYLIRSKWVPCLEFSKVGFIFREHHPSPGYYDGRYWTMWKLPMFGCTDATQVINQVEEVKRDXPDAYVPIIGFDNMRXCSAVTFIAFKPTGLARNPGKA

SEQ ID NO: 19447 - protein, 1169 aa, Methanocaldococcus jannaschii
  misc_feature (1085)..(1085): Xaa can be any naturally occurring amino acid
  unsure (1)..(1169): unsure at all Xaa locations
MVTLEKIELKNFKSFKKLSLDIPKGFTAIVGPNGSGKSNIVDAILFVLGKTSAKKLRANRFSGLITYHNGKRADFAEVCLYFTNENNAFNVNADKVGILRRIKSSGETDYYLVWKENDKEKRKKMTKHEIIDLFRRLGLLGDNVISQGDLLKIINISPIERRKIIDEISGIAEFDEKKKKAEEELKKARELIEMIDIRISEVENNLKKLKKEKEDAEKYIKLNEELKAAKYALILKKVSYLNVLLENIQNDIKNLEELKNEFLSKVREIDVEIENLKLRLNNIINELNEKGNEEVLELHKSIKELEVEIENDKKVLDSSINELKKVEVEIENKKKEIKETQKKIIENRDSIIEKEQQIKEIEEKIKNLNYEKERLKEAIAESESIIKHLKESEMEIADEIAKNQNELYRLKKELNDLDNLINRKNFEIEKNNEMIKKLKEELETVEDVDTKPLYLELENLNVEIEFSKRGIKELEEKKKELQAKLDELHAEYVKENARIKALKEMEELSMDRAIREILNANLPGIIDIVGNLGKTKIEYKTAIEVAAGNRLNHIVVKRMDDAVRAIKYLKERKLGRATFLPLDRIEGREAYYIDEDGVIGRAIDLVEFDEKYRRVFEYVFGNTVVVENIDIAKELAKKYRKVRFVTLDGDVIEPSGAMIGGTFKSKAKIKVDVDLSKLNKIADEIIAIESELRKIKEEIERLSKIVKRSSAKKMEIENTLEIIKKNEMRKREIAEKNTIKIKELELKNKDILEELEELNLKREEILNRINEIESKINELIERREKIINELKEYESDENLKRMNEIEGELKILEKEKAKLKNEIDKGLTLVKEILIPKIEELNKKVSELINKKVILEKNISFYKESIEKNLSILEEKRKRYEELAKNLKELTEKKEQLEKEIETLERERREILRKVRDIENRINELMVEKAKYESKLEEEERKLYLCEKVDVSKELEKKDIEELEIYIGELENEIKSLEPVNMRAIEDYNYVAERYKELIEKRKEYERDEKKYLQLMEELENKKKEVFMEVFNKVAKNFEEVYKEIGGIGKLSLENEKNPFEGGILIDASPRGKKLLSLDAMSGGXKSLTALAFLFAIQRLNPSPFYVLDEVDAALDVKNVSLIADMIKNASKDSQFIVISHREQMVSKADVVYGVYMENGLSKVVGIRL

SEQ ID NO: 19448 - protein, 507 aa, Bordetella bronchiseptica RB50
MPGRGCVPRFFSSDSIDMTISPLQLLNDPSLLRTDALVDGRWIAASRRFAVHDPATGRKLADVANLDAAHAREAIAAAQAAWPAWRARTVKERSAILRKWFDLLLANQDDLARLLTAEQGKPFGEARGEIAYAASFVEWFAEEAKRINGETLPAFDNNRRLLVLRESIGVCAAITPWNFPLAMITRKVAPALAAGCPVIVKPAEHTPLTALAAAQLAVRAGVPAGVLGVLPADGANSIAIGKELCANDAVRHLSFTGSTEVGRILMAQSAATVKKLSLELGGNAPFIVFDDADLDSAVEGAMQSKYRNAGQTCVCANRIYVQDGVYDAFVEKLADAVRALKVGPGFDEGVTQGPLIEPEAVDKIERHIEDAVSKGGRVVAGGRRLGGLFFEPTVLVDATSQMLCAREETFGPLAPVFRFHADEDAIAAANATEFGLASYLYSRDVGRIFRAAEALESGMVGVNVGILATEHVPFGGVKQSGLGREGGRHGIDDYVEIKYMCVGDILK

SEQ ID NO: 19449 - protein, 490 aa, Cryptococcus neoformans var. neoformans JEC21
MFSHGLSIANPPPPAERPVTHAPRCLCFFSVYLFVTFLRGAFSPPSHRSDPTAASLSISTPGPCVFLLLPSLSPSQSLVHRNTPRPFSFATQPAVSPIDGQIHTRYSNQSPVNDAMAKPTHARGHIYSLAEVAKHNTRVSTLCTYNGKVYDLTSFLDDHPGGDDIILSYAGQDIGKVMSDEDIHQHSRAAYEMLEEFEVGELGGGEKIVSEDWVCDENFQPSDTDLLSDYNLNKFIDLTKPLLIQVWHAPWTKEYYLSQVHEPRHLKESARLFGSDLLEPFTRTQWWVVPMIWWPIAGLIGWLSMLQFTDSSITAKSILTYPLPSSIPVPSFAALGYFSLCFAFGVFIWTILEYSMHRFLFHLDYYLPDTRWAITLHFMLHGVHHYLPMDKLRLVMPPLLFFVLQTPFTKLAHIVFPKAIANGIISGAFAMYVVYDLGHYALHHTRLPAYLREMKRYHLAHHYKNFELGFGVTSKMWDYVFGTVLPTTTK

SEQ ID NO: 19450 - protein, 453 aa, Brucella suis 1330
MNLFTSQFRNSQLLASKAHALIPGGCHTYAKGDDQYPVLAPGFIQRGSGAHVFDVDGHEYIEYGMGNRAVGLGHAYPPVVRAVREALQDGCNFTRPSAIELDCAESFLELIEGAEMVKFCKDGSDATSGALRLARAYTGRDMVACCADHPFFSTDDWFIGTTKMSAGIPASVSALTATFRYNDIASVEALFEDYPGRIAAIIMEPARADEPQDNFLHEAMRIAHENGALFILDEMITGFRWHMRGAQKLYGIVPDLSCFGKALGNGFAISALAGKAEYMRLGGLHHTDFPRVFLLSTTHGAETHAMAAAIATMAIYRDEPVIERLYEQGAKLAAGINEAIAGHRLQDHVRLSGRPCCLTYSTLDGNGMPSQAFRILFLQETIRRGVLMPSLVVSYTHSDADIARTIDAVHGALGIYVRALNDGVESCLVGRPSQVVYRRFNEDPASSCPPPRL

SEQ ID NO: 19451 - protein, 370 aa, Brucella melitensis biovar Abortus
MNTHSVPVTTMDAQLRERAERVIPNGMWGHQRASSLPQGYPQYFASGKDACVTDVDGNSYIDFMCAWGPIILGHRNPLVDAAALSQIELGDSLNGPTAHAVELAELLVATIPHADWALFQKNGTDATTSCVTIARGTTKRRKVLVAKGAYHGAAPWCTPSLVGVTAEDRVHLIHYVYNDVESLTAAAREAGDDLAAILVSAFKHDLAIPQESPTKEFAQAARALCDAAGAALILDDVRGGFRIDLGGSWRGTGIEPDMAAYSKAIANGYALAAVTGSDRFREAARQAYMTGSFWYGGASMAAAVATIKELRRIDGPALMKMRANAFAAALTRRPPDTGSTCFKPARRSCRWCSSPATAMPRLARVFARRR

SEQ ID NO: 19452 - protein, 140 aa, Zea mays
  misc_feature (26)..(26): Xaa can be any naturally occurring amino acid
  misc_feature (106)..(106): Xaa can be any naturally occurring amino acid
  unsure (1)..(140): unsure at all Xaa locations
AHASAHASAHACGSKKSESERVTLRXKHKVLRKVKEHHRKTRKEVKTEGKAGQLKKVEKDPGIPNEWAFKEQELMALNARRAQALQELELMMEARTERARKTKLGXLEDEEIANLASAASAHGSEFAADDAAYDKAALTV

SEQ ID NO: 19453 - protein, 378 aa, Geobacillus kaustophilus HTA426
MKAVTYQGIKDVAVKQMPDPKILKDDDIIVKITSTAICGSDLHLVHGMIPNMPEDFIIGHEPMGIVEEVGPAVTKVKKGDRVIVPFTIACGQCWYCQHGLESQCDASNPNGESGGYFGYSETFGGYPGGQAEYLRVPFANFTPFVVPENCELEDEKLLFLSDIIPTAFWGVDEAGVKDGDTVVVLGCGPVGLLTQKFAWMKGAKRVIAVDYIDYRIEHAKKTNKVETLNFTEYENVGEYIKEMTGGGADVVIDCVGLDGKMTPLELIGSALKLQGGAMGAIVIASQAVRKGGTIQLVGVYGARYNQFPLGDLFSRNITLKMGQAPVIHYIPTLYEWIVEGKFDPTDIITHRLPLDEAQYAYEIFDEKKDGCIKVVLKP

SEQ ID NO: 19454 - protein, 426 aa, Actinobacillus pleuropneumoniae serovar 1 str. 4074
MSKSEQLFEKAQKVIPGGVNSPVRAFKGVGGTPVFIQKAEGAYITDSDGKKYIDYVGSWGPMVLGHNHPAIIDAVLKAVPNGLSFGAPTESEITLAELVTKLVPSIELVRMVSSGTEATMSAIRLARGYTGRDKIIKFEGCYHGHSDSLLVKAGSGALTLGQPSGPGVPADFAKHTLTCTYNDLDSVKTAFEQYPNEIACLIVEPVAGNMNCIPPKNDFLKGLRALCDQYGAVFIIDEVMTGFRVALGGAQAYYDVKPDLTTLGKIIGGGMPVGAFGGKKEIMEYIAPTGPVYQAGTLSGNPIAMAAGLACLTELSKAGNEEKLAAQTKTLAEGFKALADKHNVLFTAQYVGGMFGLFFTEQAEITNFQEVMKCDAAKFNRFFHLMLEQGVYLAPSAFEAGFMSLAHSDEDIQATLAAADKAFAQL

SEQ ID NO: 19455 - protein, 511 aa, Oryza sativa
MVAFYGLGDGGCLVSAPAELAGMFCRGGVVVQQQQRKRSLVAASAVAAADCVARGSPNLCSLALWDVPLVTDAGLAEIAAGCPSLERLDITRCPLITDKGLAAVAHGCPNLLSLTVESCSGVGNDGLRAIGRSCSKIQALNIKNCARIGDQGISSLVCSATASLTKIRLQGLNITDASLALIGYYGKAVTDLTLVRLPVVAERGFWVMANAAGLQNLRCMSVTSCPGVTNLALAAIAKFCPSLRQLSFRKCGHMTDAGLKAFTESARLLESLQLEECNGVTLVGILDFLVNCGPKFRSLSLVKCMGIKDICSTPAQLPLCKSLQFLTIKDCPDFTDASLAVVGMVCPYLEQVDLSGLREVTDRGLLPLINSSEGGLVKVDLSGCKNITDAAVSTLVKGHGKSLKQVSLEGCSKITDASLFAISENCTELAELDLSKCMVSDNGVATLASAKHLKLRVLSLSGCSKVTPKSVSFLGNMGQSLEGLNLQFCNMIGNHNIASLEKQLWWCDILA

SEQ ID NO: 19456 - protein, 610 aa, Agrobacterium tumefaciens str. C58
MTEHDALFSEPLLLLAGAVIAASVFRKLGLGTVLGYLVAGIIIGPFLHLVTDAKDIFNVSELGVVFLLFIIGLELKPSRIWQMRRDILGLGLAQVLVTGSALAAIAWWAGLIDARGSVVAGFGLALSSTAFALQILEDDGDMNTRHGNRSFSILLFQDLAIVPLLALVTILSNRPDVPTDSMAYDLVASVVAVAGMVLAGRFLLTPMFQIIARTGAREVMIAAALFVVIGAAAIMEMVGLSMGMGALLAGLMLSESSYRHELEADIEPFRGLFLALFFMAVGMSLHINIVYEHIVLILIAVPVMMAVKAALIYGLCRIAGSSRYASSRIALLLAQGGEFGFVLFTTAAASGLFPQATASILVAVVTLSMALTPVLAVISRRLTAEDAEEDKLEEDFDGAGADVLMIGFSRFGQIASQILLAGGRDVTVIDSSADRVRQAARFGFRIFFGDGTRKDVLIAAGIERADLVAVCTHKKEVTDRIIDMIQSEFPSVRIYARSYDRIHSLDLRKKGVEYEIRETLESGLLFGRRILEGLDMDAERALAISDDIRERDEQRLELQAVEGLAAGRQMLHNKPVREVKPEPLMKPKNKAEKREEEEEDMEESETEVLL

SEQ ID NO: 19457 - protein, 520 aa, Aspergillus nidulans FGSC A4
MAKVDQKVVLIVIDGWGVAGPNSPKEGDAIAAAETPFMSGFAEENSKTAQGYTELDASSLAVGLPEGLMGNSEVGHLNIGAGRVVWQDSVRIDQTLKKGELNKVENIAASFKRAKDGNGRLHLLGLVSDGGVHSNITHLIGLLKVAKEMEIPQVFIHFFGDGRDTDPKSAAKYMQQLLDATKEIGVGEIATVVGRYYAMDRDKRWDRVEIAIKGILSGEGEESSDPVKAIEKRYTEDETDEFLKPIIFGGKDRRVQDDDTLFFFNYRSDRVREITQLLGDYDRSPKPDLPYPKNIHITTMTQYKTDYTFPVAFPPQHMGNVLAEWLGKKDVQQCHVAETEKYAHVTFFFNGGIEKQFPGEVRDMIPSPKVATYDLEPEMSAEGVGKKVEERIAEGKFEFVMNNFAPPDMVGHTGVYEAAIKGVAATDKAIGIIYEACKKHGYTLFITADHGNAEEMLNEKGTPKTSHTTNRVPFIMANAPEGWSLRKQPGVLGDVAPTVLAAMGIEQPKEMSGESLLVKA

SEQ ID NO: 19458 - protein, 166 aa, Triticum aestivum
  misc_feature (109)..(109): Xaa can be any naturally occurring amino acid
  misc_feature (123)..(123): Xaa can be any naturally occurring amino acid
  misc_feature (131)..(131): Xaa can be any naturally occurring amino acid
  unsure (1)..(166): unsure at all Xaa locations
MAPAVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDXRYWTMLKLPKFGCXDATQVLNXWRSQEGVPDPMSRIGSQLRKCMRNSLKHGKDPRLT

SEQ ID NO: 19459 - protein, 568 aa, Debaryomyces hansenii CBS767
MTKDYIWWKDASVYQIWPASYKDSNGDGVGDIPGIISTLNYVKSLGTDVIWLSPMYDSPQDDMGYDISNYEKVYPKYGTLEDMDNLIEGTHKRGMKLILDLVINHTSTEHDWFKQSRSSKTDPKRDWYIWKPARYDAEGNRHPPNNWVSHFSGSAWAYDETTDEYYLHLFAESQPDLNWENEETRKAIYKSALSFWFEKGIDGFRIDTAGMYSKVQSFSDAPIVFPDSEWQPCQKYFQNGPRIHEFHKEMFASVTSKYDAMTVGEVGHSPREDSLKYVSAKEKEMNMMFLFDAVEVGSNPSDRFIYDGYKLTDFKKAVQNQSSFIEGTDAWSTVFYENHDQPRSITRFGNDSNKYRVKSGKLLALLQSTLSGTLYIYQGQEIGMTNLPRSWSIDEYLDINTINYYKEFKAKYGDNKEKMDKLMDNINLLARDHARSPVQWDDTENAGFSTGKPWMRVNDNYKEINVASQVNDPNSLFSFWKQSLKIRKEYKDLLIYGSFKILDNENQKIFTYVKEAAGQKAYIVLNFTSESLKFENLDGGKLELLHSNVNVEDEGTLSPYEGRFYLIK

SEQ ID NO: 19460 - protein, 397 aa, Mesorhizobium sp. BNC1
MPDISKRITGIMPSGKDGWEVHFAALTRKLAGENILMLSVGDHDFDTPAGTVEACVEAVQSGHHHYIQLPGLPKLRQALARLSTECTGVDTAPEEVIVTQGGQGALYASCQAVLDPGSHAVIVSPYYATYPGTVRAAGASFTEIETRSEDGFEPRVEAIAAAIRPETRMILINSPNNPTGAVYSRATLEAIAEICRRHDLWLLSDEVYWTLRGEREHVSPRSLPGMKERTLVVNSLSKSHGMTGWRVGWLTAPAEVVKLLISLNIVSSYGMVDFVSRAAVAAVENGHGVQEIAARYGSRRKAFLDEIRGANDIVVRGSEGGMYVMLDISHINPDAEAFAWGLLEAEKVAVMPGPSFGAAAQGHIRISMCQEEPVLREAAMRIRRYIASEITRRDAAE

SEQ ID NO: 19461 - protein, 526 aa, Triticum aestivum
MAMAMRRAAALGARHILAASASASSRVASRRHMGSVDAGAAMDKIRAAGLLRTRGLIGGQWVDAYDGKTTEVQNPATGEVLANVACMGNRETADAITSANTTFYTWSKLTASERSKALRKWHDLLMSHKEELALLMTLEQGKPMKEALGEVNYGASFIEFFAEEAKRVYGDIIPPTLADRRLLVLKQPIGVVGAITPWNFPLAMITRKVGPALACGCTVVVKPSEFTPLTALAAADLALQAGIPAGALNVVMGNAPEIGDELMQSTQVRKITFTGSTAVGKKLMAGSANTVKKVSLELGGNAPCIVFDDADIDVAVKGSLAAKFRNSGQTCVCANRILVQEGIYEKFASAFVKAVQSLQVGNGLEESTSQGPLINEAAVEKVEKFVGDATSKGANIMLGGKRHSLGMSFYEPTVVGNVSNDMLLFREEVFGPVAPLIPFKTEEEAIHLANDTNAGLAAYMFTKSIARSWRVSEALEYGLVGVNEGLISTEVAPFGGVKQSGLGREGSKYGMDDYLEIKYVCMGNLG

SEQ ID NO: 19462 - protein, 1732 aa, Candida albicans SC5314
MRRRHKDKHNTDSVSDMSSNDSASILSSASQNSTHSRRSASLQSLHSQSHQYPQGHNNSSHRQASTYSISSLSPYDKGASLSRKSTNISISRPIKTNDSNVFPIKQSFQLERPNSAFEIERMFRELLEKLNFKSLPPQATREMLNYDIDRKWMMIEQDARAEYDRQQRYARAQNIFSPEEYAKVLMSKQVSTNQLSGLWLALRSEPIDWVRRFVYDCQGDTLLSVYLTKLQQEMVSCNITDIEDDIFDKEVNVLQSLKCLMNQRLGAERIKTDVDVFVNAVSGSLLSPRIITRKLATDTLTFMISYNGNNDNGRYHKVLRALDSINEKSRMEFDSPDNYSPRKLTRKPPQPANFKRFELWLNVVEKTIDARGKFRNSDVGASDELKSAYAGTRGSVITTRNQLENHLVEYCIATMLLINVIVGNGTDYRVRIHLRAQFRAAGLDRIIHKFLELGNEELDNMITRHKIDANNDEEELKYSANFNNEDNEVDFNDPVNLVQSLWQSVKNSDAEGYFLSAIQHLFLNQSEKRGNPEEMNRSLRVLDGLIQNISSVRTVSEDTAINVAINKLISNMSTDDMYRKALEDVKIYRRIAEEATAERDDMSRQLSMGADGYINSLLNDVKERDMVISRFRRINEDMKEELEQMKTKYMQEKQESELEMRELLIMLNNSEIGANAVKKDGGKTTISISTSNEELAARLKKQIHRRRAEYKLDNRQLGTNVEPSSRLRALRDQMGDIENMARELEMTDFETYADPEEEENNNDQSPEKSEIDESRSSQESEAEIQSVEEDEEEEEKEVVIPPLPVPSGPKRAVRNDDLVRLDHLRKKLANLQSESNDIMKYNSSSMFNKQKFLAMERLQELENNFKDFNIDFAVSDPEDKYNFNSNAGSVDDSIKNKTKEVLAEAEQIREELRRQLAAAQKIKSPSPKRNTVLERIENKYVKGQVKIDAPDVVSNSPRTQKRAHRSTTLNAMDPKFLQELSLKVGKAEPIQDANNKNQFGGPLSSSPEDVSQKHKTSGDSSDKDKVLSSPISSNDIKSPETGNSTTSSAAPPPPPPPPPPPPPPLPPILGGNNSSAAPPPPPPPPPPPAFLNGSGSVIPPAPPLPPPSSGRSSRSVPSTVTKSSGSAFDKIPRPKKKLKQLHWEKIDHSQVGNSFWNDPNTHTLVDDLMSKGIFDEIELIFAAKEAKKLATKKKEDLDKVTFLARDISQQFSINLHAFNSFSDEEFVLKVLRCDKDVLTNPAVLDFFGKEDIVEITNTLARNFEPYSTDYKTEEITKPEKDPNELQRPDRIYLELMYNLQHYWKSRTRALNVVVNYDKDYVEYVKKLRLIDEAVDSIKNSKHLKGVFEIILAVGNYMNDSAKQAHGFKLSSLQRLSFMKDEKNSMTFLHYVEKVIRTQYPEFLEFINELSCCNEITKFSIENINNDCKEYARAIKNVQSSIDIGNLSDVSKFHPSDRVLKAVLPALPRAKRKAELLLDQANYTMKEFDDLMKYFGEDPTDQFVKNSFISKFTDFMKDFKRVQAENIKREEELRVYEQRKKLLEKPKSSNNGDSNASDQDGESNEGDGGVMDSLLQRLKAAAPTKGESASARKKALMRKQILESQRKRTTGSVGSPTNVSPTRNNESDSGVDNKDDTHGSSPLDEQFHDSITTQEDRIRDDNRPPEGVADFSNVEDPENPDVGARAKNLLQELRGADESSSKLSDAQRYRQERLKKKSVQIDLDEVAKNNNSE

SEQ ID NO: 19463 - protein, 267 aa, Bacteroides thetaiotaomicron VPI-5482
MKLVKPKKFLGQHFLKDLKVAQDIADTVDTFPELPVLEVGPGMGVLTQFLVKKDRLVKVVEVDYESVAYLREAYPSLEDHIIEDDFLKMNLHRLFDGKPFVLTGNYPYNISSQIFFKMLENKDIIPCCTGMIQKEVAERIAAGPGSKTYGILSVLIQAWYKVEYLFTVSEHVFNPPPKVKSAVIRMTRNDTKELGCDEKLFKQVVKTTFNQRRKTLRNSIKPILGKDCPLTEDALFNKRPEQLSVEEFISLTNQVEEALKTATASGN

SEQ ID NO: 19464 - protein, 236 aa, Nicotiana glutinosa
MMKPQKSLLVKIFVVQCLLVLCVAQDFDFFYFVQQWPASYCDTRRSCCYPTTGKPDEDFSIHGLWPNYENGKWPQNCDRESSLDESEISDLISTMEKNWPSLACPSSDGVRFWSHEWLKHGTCSALGERAYFQAALDFRKKSNLLENLKNAEITPRNGEHYTLESIKKAIEEGVGHSPYIECNVDTQGNHQIYQVYLCVDKTATDFIDCPIFPHGRGCGSKIEFPPFSSESDHDEF

SEQ ID NO: 19465 - protein, 131 aa, Candida glabrata CBS 138
MSGGKGGKVGSAAKASQTRSAKAGLTFPVGRVHRLLRRGNYAQRIGSGAPVYLTAVLEYLAAEILELAGNAARDNKKSRIIPRHLQLAIRNDDELNKLLGNVTIAQGGVLPNIHQNLLPKKSAKPSASQEL

SEQ ID NO: 19466 - protein, 538 aa, Phanerochaete chrysosporium
MLVSVDALALRTLVYELTYLLYPAVPTAAALILLQRFGNVWLPTWTIVLLSLCNVPVAHRILVWLKDGRRWPGSIDLLRQLTQTFETGFLSEMLWGYMHVLGQTFEVYILWDSNYVTSDANVIKTILATDFDNFVKGEKLDVCVRPVLGTGVFNSDGEMWKFHRSMTRPFFTRERISHFDLFDRHADATMAKMKARLAEGFAVDFQDLISRFTLDSATEFLFGQCTTGASRTEDFARAFAEAQDAVSFRLRMGWLWPDAVARADKIKRENGGRVPEVKGEIEEDETLLDHLVNVVQTKILHDEVLNIMIAGRDTTGGTLTSAVYFLSQYPEVLRRLREEILEKVGPTRRPTYDDIREMKYLRAFINETLRLYPAVPWNVRYPVKDTTIPGPHPDKPYFIPANTPVSYSVHCMHRRTDYWGPDAEAFDPDRFLDARVQRYLTPNPFIFLPFNAGPRICLGQQFAYNEMSFFVIRLLQHFDEVQLCEDALAPDCRVPDAWRGAPGRKGVERFWPKAHLTLYAKGGLWVKMREASTSEAVV

SEQ ID NO: 19467 - protein, 538 aa, Oryza sativa (japonica cultivar-group)
MSRLSSIYSQHRTSGLRSDRSIMPNSTSNSLRTISSVHLPYNHRARNFHISHAVGDSSEHVIINGQASPSKVVQADAAALGTIAADMAPVVDGFSADDDELDLDSPTEGFSSIPEAIEDIRQGKYVIVVDDEDRENEGDLIMAASKVTPEAMAFIVRHGTGIVCVSMKEDDLERLELPLMVTTKENEEKLRTAFTVSVDAKEGTTTGVSAKDRANTVLALASPNSKPEDFNRPGHIFPLKYREGGVLKRAGHTEASVDLAMLAGLPPAAVLCEIVDDDDGSMALLPKLQDFARRENLKIISIADLIRYRRKRDRLVERVCVTPLQLQWGSFQSYCYRSLIDGMEHIAMVKGDVGDGQDILVRVHSECLTGDIFGSARCDCGNQLALAMTMIEKTGRGVVVYLRGHEGRGIGLGHKLRAYNLQDDGRDTVEANEDLGLPVDSREYGIGAQILRDLGVRTMRLMTNNPAKYTGLKGYGLSVLGRVPLLTPITNENRRYMETKRLKMGHVYGTRPSGNTSTLADGGIKKEQDQIDSASEQE

SEQ ID NO: 19468 - protein, 542 aa, Escherichia coli CFT073
MVSALWTVELNDSKTGTHVGLRHKHTFLCTLFRCHLSLERGTTTFVIPDSLSGSAPRKQVSPILLNLKTKTVMKKTKIVCTIGPKTESEEMLAKMLDAGMNVMRLNFSHGDYAEHGQRIQNLRNVMSKTGKTAAILLDTKGPEIRTMKLEGGNDVSLKAGQSFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 19469 - protein, 409 aa, Rubrivivax gelatinosus PM1
MPKPIAKSSKLANVCYDIRGPVLDKARAMEEEGQKIIKLNIGNLAVFGFDPPDEIVQDMIRNLSQTAGYTDSKGLFAPRKAVVHYAQEKAISGVTVDDVYLGNGASELIVMSLNALLDNGDEVLVPAPDYPLWTAAVSLSGGNPVHYLCDEASDWYPDIDDIRRKITPNTRAIVVINPNNPTGALYPESLLREIVELARQHQLIIFADEIYDKTLYDGNTHTSIASLADDVLCVTLNGLSKNYRACGYRAGWMVVSGDKRCAKDYIEGLNMLASMRLCANTPGQLAIQTALGGYQSIKDLVAPGGRLTRQRDMAYELLSQIPGVSVVKPKAALYMFPRLDPKLYPIQDDQQFAYELLAEEKVLIVQGTGFNWPQPDHFRVVFLPNSDDLSDAIGRIARFLDHYRKRHSV

SEQ ID NO: 19470 - protein, 188 aa, Arabidopsis thaliana
  misc_feature (143)..(143): Xaa can be any naturally occurring amino acid
  unsure (1)..(188): unsure at all Xaa locations
MAGGGTEAFPDLGEHCQDPDCKLLDFLPFTCDGCKLVFCLEHRSYKSHNCPKSDHGSRTVSICETCSIAIETTGFDERGIKSLLEKHERSGDCDPNKKKKPTCPVKRCKEILTFANNLTCKDCGVKFCLKHRFPTDHDGYNKXIINTAGTSSRWNERFMEALSLRNQKGCGTMGALFHPKSSPSVRSF

SEQ ID NO: 19471 - protein, 302 aa, Paracoccidioides brasiliensis
MTSERESKTFLARLCEQAERYDEMVTYMKEVANLGGELTVDERNLLSVAYKNVVGTRRASWRIISSIEQKEDSKGSEKHVAIISEYRQKIETELERVCQDVLDVLDQSLIPKAESGESKVFYHKMKGDYHRYLAEFASGNKRKVAATAAHEAYKNATDVAQTELTPTHPIRLGLALNFSVFYYEILNSPDRACHLAKQAFDDAIAELDSLSEESYRDSTLIMQLLRDNLTLWTSSDGAEPEPVAAGDGKDDKTAEGEEGPATATTTDAPAPEEVAAPAAADEEPKKEGTNGVLKYGFKKNLF

SEQ ID NO: 19472 - protein, 434 aa, Cenarchaeum symbiosum
MDLEREYRAKTRGSAGIFARSRRYHVGGVSHNIRYYEPYPFVTRSARGKHLVDVDGNKYTDYWMGHWSLILGHAPAQVRSAVEGQLRRGWIHGTANEPTMRLSEIIRGAVKAAEKIRYVTSGTEAVMYAARMARARTGKKVIAKVDGGWHGYASGLLKSVNWPYDVPESGGLVDEEHTVSIPYNNLEGSLEALRRAGGDLACVIVEPMLGGGGCIPAEPDYLRGIQEFVHSKGALFILDEIVTGFRFDFGCAYKKMGLDPDVVALGKIVGGGFPIGVVCGKDEVMCISDTGAHARTERAYIGGGTFSANPATMTAGAAALGALRERRGTLYPRINSMGDDARARLSRIFDGRVAVTGRGSLFMTHFTPDGARRISSAADAAACDVHLLHRYHLDMITRDGIFFLPGKLGAISAAHSRADLGAMYSASERFAGGL

SEQ ID NO: 19473 - protein, 346 aa, Brassica napus
MKATLAPSSLISLPRHKVSSLRSPSLLLQSQRPSSALMTTTTASRGSVAVTAAATSSVEALREGIAEFYNETSGLWEEIWGDHMHHGFYDPDSSVQLSDSGHREAQIRMIEESLRFAGVTEEKKIKRVVDVGCGIGGSSRYIASKFGAECIGITLSPVQAKRANDLAAAQSLSHKVSFQVADALEQPFEDGIFDLVWSMESGEHMPDKAKFVKELVRVAAPGGRIIIVTWCHRNLSPGEEALQPWEQNLLDRICKTFYLPAWCSTSDYVDLLQSLSLQDIKCADWSENVAPFWPAVIRTALTWKGLVSLLRSGMKSIKGALTMPLMIEGYKKGVIKFGIITCQKPL

SEQ ID NO: 19474 - protein, 609 aa, Oryza sativa
MVGVLLLLSIMPLAAGELLAQLCGNGGNYTANGTYQSNLARLAAALPSNASSSPDHFATATAGQAPDAAYALALCRGDVANATACGDCVAASFQDARRTCPSDKSATIYYDDCLLRFAGDDFLAAPNITENATLFQAWNQQNITGDAAVAAANVRELLTVTARTAAAAARRFATGFMDGSSESKQTLYSLAQCTPDLAAGDCLACLQRLIAMVNSTTSVRLGGRVLLLRCNLRFEAFVFYAGEPTRRVSPPGSTPAPDSIAPTKNRKKSKSWVIAAIAAPVAAVVLCLIVCYYCRWSRRFRKDRVRLREKRSRRFRGDELICEMEGEISEFSVFEFREVIKATDNFSEENKLGEGGFGPVYKGLFSEGLEIAVKRLASHSGQDERKKDLLDWNKRLVIIEGIAQGLLYLHKHSRLRVIHRDLKPSNILLDSEMNPKISDFGLAKIFGSNSNEGTTRRVVGTYGYMAPEYSSEGLFSPKSDVFSFGVIILEIISGKRNASLDQCEDFINLLGYAWKLWSEERWLELLDASLVTNWQSSCMLRCINIALLCVQENAVDRPTMSNVVAMLSSESMVLDEPKHPAYFHVRVTKNDESSTVGTCSTINDVTINY

SEQ ID NO: 19475 - protein, 168 aa, Lycopersicon esculentum
TRLNCVIVSVDGSEESMNALNWTLDNIKLKPHDPDSPESQGFIVILHVQSPPSIAAGLNPGAIPFGGPSDVEVPAFTAAIEAHQKRITQAILDHALGICAKKNANVKTQVVIGDPKEKICDAVEEMNADLLVMGSRAFGPIKRMFLGSVSNYCTNHAQCPVIIVKATP

SEQ ID NO: 19476 - protein, 434 aa, Triticum aestivum
  misc_feature (309)..(309): Xaa can be any naturally occurring amino acid
  misc_feature (342)..(342): Xaa can be any naturally occurring amino acid
  unsure (1)..(434): unsure at all Xaa locations
MRAKGRSILGGDRQSFQEYTDRVTLRSDDQGVTTTPNPRRIRRRSISITPEIGDDIVRAVRAMNETLKQNRLQRDHVNDGSCSYIGADESNANDCPNNDDKSGTNNGLRNRAGSTQKAMSLPTSPHDYGGEISETSNNCDFISEEKMVFAWNRVLQSSPFNKPLSPFQEWNIDFSELTIGTRVGIGFFGEVFRGIWNGTDVAIKVFLEQDLTTENMEDFCNEIYILSRLRHPNVILFLGACMVPPHLSMVTEYMEMGSLYYLIHMSGQKKKLSWRRRLKIIRDICRGLMCIHRMKIVHRDLKSANCLVXNKYWTVKICDFGLSRAITDSPMTDNSSAGTPEXWMAPELIRNEPFSEKCDIFSLGVIMWELCTLSRPWDGIGPVKVVYAVTEGSRLEIPEGPLGKLIADCWAEPQDRPSCQEILARLLDCEYADS

SEQ ID NO: 19477 - protein, 380 aa, Zea mays
SESESEAASRRQGEMGKGAQGSDAAAAGGEVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLEEGAMCEPLSVGVHACRRAGVGPETGVLVVGAGPIGLVSLLAARAFGAPRVVVVDVDEHRLAVARSLGADAAVRVSPRAEDLADEVERIRAAMGSDIDVSLDCAGFSKTMSTALEATRPGGKVCLVGMGHNEMTLPLTAAAAREVDVVGVFRYKDTWPLCIDFLRSGKVDVKPLITHRFGFSQRDVEEAFEVSARGRDAIKVMFNL

SEQ ID NO: 19478 - protein, 154 aa, Arabidopsis thaliana
  misc_feature (53)..(53): Xaa can be any naturally occurring amino acid
  misc_feature (149)..(149): Xaa can be any naturally occurring amino acid
  unsure (1)..(154): unsure at all Xaa locations
ARNPGAAHTRPNRAKEEGNHQEVVWVSFMLSSAVGVTSPVKATMVVQLTGWKXSVEFPVTRRTNRAIISIEGNGGGVSCLKGWPPIGKKKLGTLFNLPDLRDVKWVKEVDYLFRTRGIPGVEFKWEHGFGYRGHGTTPGSYDGRSWTLXKLPLF

SEQ ID NO: 19479 - protein, 230 aa, Bradyrhizobium sp. BTAi1
MDALKRQAAAHALREVESGMKLGLGTGSTAKHFVDLLGEKVRAGLKVVGVPTSEATRAQAEACGVPLTTLDEIDHLDLTVDGADEINPALDLIKGGGGALLREKIVASASDRMIVIADESKWVARLGRFPLPIEVIPFGLAATRHAIAAAFAKAGVSGQMDLRKSADGHVFVTDGGHWIVDVRLGEIEDPPRLAGLLSAIPGVVEHGLFIGLGSTAILAGAQGIRVIQRP

SEQ ID NO: 19480 - protein, 1465 aa, Cryptococcus neoformans var. neoformans B-3501A
MTSNPQLKSSAQASYPAHSGQSPQLNQHLPGQVDTHAGHMSMMSTPHPQLGYRINPQSPTPSANGPAASGGYGGSPHLGMSPPPIHSSAPASVQASAQPQQGQLQHQALHSNHPQGQSQEIGQGQLQSRPHPSPNPLSYPWQIRPLRLYSSGQNVPASPFPRYGLSVPCFPSHSGHMLVFGGLVNEKVRNDLWSIDIRDLSVMYVKTKGDAPPPRVGHASVIMDRIMVVWGGDTKIDVADEQDEGLYILDLRSQEWTKVPISKGPVGRYGHAACMVENRFYVFGGQADGMFMNDMWMYDIKQLSGTAMVHTWEQVSYTTPPPPRRTGHVLVAASSGKLYLFGGTDGNYHYNDTWCFDPSTGAWAELSCIGFIPLPREGHAAAIVDDTIYIFGGRDVKGKDLGDLAAFRLSNQRWFMFQNMGPSPAARSGHAMVSAHGKIFVVGGEANQVPLEPGERDDPQKIHVLDTSKIKYPHDAKSKTTMADQADSRGMQGTPQPGQQQGQTPGRLPQSASTEGLNTRTGTSSPSSERGPSTQHVLTQSQSQVLDTQVSPQSQAQIPQPPLQSPRNVGPVLTTKPNGPPPQRPRREGDEEFREAMSPTKLHYSSQASDQAQSPVQSSLPSRVTSPTHISPTSPKNHPKMFHSSVNGTRSPSPRLRNADGPSSERERAPPPPDAFYYGRRSPTANGFRQSASSRPSSFGASNDLVKEVRAKENEVEEGKRRETALKIILNRAVKQGFLLGDEEQKPSGGDKEEQADDNKQNDGLVGRLTDALVRLKKEKAKMQNDLVAQIRAASAKSVEADHLRRGALQETAFYRAKIAALETNSLLDLKRVEKERINELEKQINILANENAQMSKELEWEKEGREQANCLHSSATQREAETLRRAEEAEEAQKEALEELERLRGHFLTYEQGAREHSEQLITLSSRVQQREAERDQLRSQLDEAIATRDQNIQLVSEVQAAITSAGLMASEMEAMYTKESVKVQQLEEELAECRAELESRTRNAELATEKLKEIENAYAKSREEADALRAVTTSRLGEILDSHKEMRADETRAARGHQEQLQALEEEGKSLRKMLKEAGQRVDAAESGVNQHRTKMRDVESKVQTLRGELRTSQTKLLSAQAEVARYKQLHSTRDEELKEKEIAMTEVETRCAMLRNLLADHGIAVNDSDLEDIKAPSTRELEGKLREQTRVSEAAQREIQDLRTRCEEAEVKVESLGKLVERIKGARSPTSASMRSPTPTSGEMTRVSELEKKLIDMEKEHRDKVAGLETDYQTAVRQKATNTTIQTELDHLRGRSSISGRSTPSSSSVIESDVQRRFNVLQNQHQKLQEDFSASQDVLSARNREVDLLRMRLDEAERDMESLRDDLAQAQHRIQTLLDVKGGSDDEDDGSLEATMAFDKFSQELKQWERSRSPGEGNFEDKSSEEGTTMPGQSASYQARVVAQSSKAHSPSSSEYSGDWVQ

SEQ ID NO: 19481 - protein, 464 aa, Photorhabdus luminescens subsp. laumondii TTO1
MQASLQLERGLNARHIRFMALGSAIGTGLFYGSAEAINMAGPAVLLAYLVGGAAVFMVMRALGEMAVHRPDAGSFASYAHQYLGPLPGFITGWTYTFEMIIVCLADVTAFGIYMGLWYPEVPRWIWVLSIIFIIGALNLCKVKVFGEMEFWLSILKVAAISAMIIAGTGIILFGFSGHFQATGVQNLWQHGGFMPNGLGGIIESLAVVMFAFGGIEIIGITSSEAKNPAKVIPQAINSIPFRILLFYVLTIFVLMAIYPWNSIGQEGSPFVAIFQGLGIGSAANILNIVVITAAISAINSDIFGAGRMMYGMAEKGLAHKKFMHLSRNGVPWVTIMVMTLALLCAVVLNYLLPKQVFVIVASIATFATVWVWLMILLSQFAMRRKMSPGEAQKLQFPVPMWPVAPILTIVFMIFIIAVLSYFPATRIAFYVGGAWIALLTSAYYLWIRKNVIIVSAQSAKETRC

SEQ ID NO: 19482 - protein, 391 aa, Leuconostoc mesenteroides subsp. mesenteroides ATCC 8293
MTNPTQPFNSIVLDMAPDKLLDFQLKVRDIPDILRLTFGEPGFAVDERIKQATIDAITNDRSHYAESQGETDLRIAAVAYFNREYHLNYNGPENIIITQGVSEAINVIFQTLLNDNDGLLVPEPAYGPYFSSLDLAHGVRLSIDTTANDFKLTPDMVEETIKNATVPVKAILMNYPTNPTGVTYSRDEIIALAETFTKHNLWVISDEIYSVLTYDQEHVSFAEYIPERTIYINGLSKSHAMTGYRVGFILGQAETIAQLQKTHGTLVFAVPTFVQDAALVALRDVTDTPVKMRDIYRQRRDKVLSQLQALGFDVVEPEGAFYLFAKLPADLGTDGDVFALQLAKEGKVAVIPGSAFSDAAQAYIRISYAASDEDLAEGMKRMTKYIEKVRG

SEQ ID NO: 19483 - protein, 371 aa, Arabidopsis thaliana
MPPKQQPKADLAKKQKQVEDKTFGLKNKNKSKNVQKYVQSLKQSVQPKPDATKAAAKKKKEEEKAREQELNELFKVAISQPKVPVGVDPKSILCEFFKAGQCQKGFKCKFSHDLNIQRKGEKIDIYSDTRDEDGDMDEWDQETLEKVVESKKNEYNQNKPTDIVCKYFLDAVEKKQYGWFWSCPNGGKECHYRHALPPGYVLKSQMKALLEEESSKKLAVEDEIENERAKLQTATQMTPALFMEWKRKKIAERDAGLAASQAERAKNDRMSGRELFLSNASLFVDDAEACEEYEREREQEETEQKAKNKEAEAGTSKSSGDAEQSSKEVNEEEEDDDDDDDDLDMDELDELEASLSKTSIQIREPNDEGSS

SEQ ID NO: 19484 - protein, 293 aa, Glycine max
MALSLTSNGVNEYQKCVVEEEDGSQSTNGLSNDSASAITNSPPLCGNEYVHKSTHYQLEEAESLINFKANDQYNNLMQGSESFLSFQQSWMFSKESNLHEGYNQWNHVISPKSPTDMRLVQNFSCFETATGYSSIFNGAKDKQHGESSSSGWLYSEPNVPSDSLHESAAQELVLKKRSFMGENMQVTNAKKPCTSASKAAKPKSNPSQDPQSVAAKNRRERISERLKILQELVPNGSKVDLVTMLEKAISYVKFLQLQVKVLAADEFWPVQGGKAPDISQVRQAIDAILSSQR

SEQ ID NO: 19485 - protein, 430 aa, Shewanella sp. MR-4
MTRSEALFEQAKKTIPGGVNSPVRAFNGVGGSPLFIEKADGAYIYDADGKAYIDYVGSWGPMILGHNHPKIREAVLAAVHNGLSFGAPTELEVQMAEKVIAMVPSIEQVRMVSSGTEATMSAIRLARGFTNRDKILKFEGCYHGHADCLLVKAGSGALTLGQPSSPGIPEDFAKHTLTAVYNDLDSVRTLFEQYPIEIACIIIEPVAGNMNCIPPIPGFLEGLRTMCDEFGALLIIDEVMTGFRVSRSGAQGHYGVTPDLTTLGKVIGGGMPVGAFGGRKDVMQFIAPTGPVYQAGTLSGNPIAMSAGLAQMEALCEEGLYEALSAKTKRIAEGFKAAADKHGIPMAINYVGGMFGFFFTEQEQITRFDQVTKCNIEHFRTFYHGMLDEGVYLAPSAYEAGFLSMAHGEEELRLTLEAADRVLARMKAAM

SEQ ID NO: 19486 - protein, 592 aa, Candida glabrata CBS 138
MIEEDTESVRSGTYSADLQPLDFDARSRVQINDVTNFDHDQFEKYLVRPDYVKLLKKQADCDILPFKRLFLAQELQLGGSSVTVSRFSKDGTLFCVGCKDGSLMVLKVLQTKSEKLGISDAECEETGKRKIQYAPIFNELDIVSLNSDEKVHREVLDLSWSVNHFLLVSSVDSYVTLWTPFDGNRPIMRFDHPDLVTSAKFIEADDRFFISGCLDHCVRFWSVTDNRVEYSFNCEEPINVVTVSPGMSHFTVVGTFGGYIYVFSTMGLKLIDKFHIINGRSIDGNLRNGADKIKITGIEWIVTDNRLDEIQEDNEYSTARIVVTSGDERIRVFKLTEGGYHNLELKGFHCEQFRHRAQLCIWDDKPFIYCSSEDQWFYVWRLNYQDLMLTRATNEILYASTTHRRRRTERILGHTKEVTSSVLDMFFSTYAAADVEMGSNDKGMRHGQQQSMTFSHESTVTQTMPIGQPTGSTTKSTIEEQREENYILRHSHTFSFHAHDHPITTVNIAPIGTIAAVTQSNDFIYEFTCRCYSNNVELRDVEMDSCDIIGPIVVTTDSVGKLRVFRTDLSDIARETLINVLHSAMETKQSTF

SEQ ID NO: 19487 - protein, 448 aa, Geobacter sulfurreducens PCA
MSGADYCPNSPEEVRRMLDAVGVADIDDLFRPISPALRAKSFDLPPGMSEFEMLHRLQTLAGRNAQGLVHFVGGGFHDHLIPAVVDHLASRPEFYTAYTPYQPECSQGTLQALFEYQTAICRLTGMEVANASLYDGGTALAEAALMALRITGRSRLVVDGAVNPFHREILATYLANLDVELVEIAPKAGMEDDARLRAAIDDATAAVIVQNPDFFGTLSDLSGLAAEAHGVGALLVASVYPISLGLVRSPGSMGADIVVGDGQSLGNPLSFGGPSFGFIAGRREHIRNLPGRIIGETVDRNGARGFVLTLQAREQHIKRHKATSNICSNQSLCALRGLIFLSALGSEGMAELARLNRDKAEYAKAVLGAVPGVEVLNSGFTFNEFTVCLPKVAEEAVVALLRKGVAAGVPLGPYYPDMEKCMVVTVTERRTRAEIDAFARQLEGALWN

SEQ ID NO: 19488 - protein, 481 aa, Geobacter sulfurreducens PCA
MELIFEKSVTGRRGVRLPASDVPPAPPLSAVLARDGAPDLPQVSELDVVRHFTTLSRRNFSVDTHFYPLGSCTMKYNAKALEEAAKLFAPYHPMVPLLPHGASFSQGSLGLVHGLGEALAEITGMDEVTCQPLAGAHGEMTGIMLIAAYHEAKGNRKKYVVVPDSSHGTNPASAAMVGYEIITVPTAPYGDMDLEKYRAVMTDEVAAVMMTCPNTLGLFNPHIREICDIAHDHDALMYYDGANLNAILGKVRPGDVGFDVIHVNLHKTFGTPHGGGGPGSGPVGVKKLLASYLPGPRVVKNSDGDYSVIPHSHESIGRTAGFFGNFGVMAKAFAYITMLGREGLIQVSEQAVLNANYIMARLKDVYDLPYDQTCMHECVFSAARQARNGVHAIDIAKFLIDRGFHPPTVYFPLIVKEAIMIEPTETESKETMDAFIEAMRDAADLAERNPAAFAELPRTMPITRPDETKAAREQNVCYFGC

SEQ ID NO: 19489 - protein, 295 aa, Zea mays
MALVREHGGYYGGFDSVEAAALDTLGYGHGASLGFDASSALFGEGGYAAGGGDAWAGAGASTVLAFNRTTAAAAVGVEEEEEECDAWIDAMDEDDQSSGPAAAAPEARHALTASVGFDASTGCFTLTERASSSSGGAGRPFGLLFPSTSSSGGTPERTAPVRVPQKRTYLSAEPQAVSPNKKHCGAGRKASKAKLASTAPTKDPQSLAAKNRRERISERLRALQELVPNGTKVDLVTMLEKAISYVKFLQLQVKVLATDEFWPAQGGKAPEISQVREALDAILSSASQSQRGQLN

SEQ ID NO: 19490 - protein, 715 aa, Arabidopsis thaliana
MASIGLYEAFIGFLCFLISFYFLVKKPFRYLLIKKTHQSYPWNWPVLGMLPGILLRLQRIYDYSVEFLENSNMTFQFKGPWFVGMDILATADPTNIHYIMSSNFSNYIKGPIFHEIFEAFGDGIINTDAELWRDWRNASQLIFNHQRFMFDITFIFLTGTDPRSLSIEMPEIEFAKALDDVGDVIVYRHITPRFVWKLQKWIGIGTEKKMSKANATLDRVCEKLIAAKREELRSQGIIDNANGDSEDLLTSHIMLDATKYELLNPNDDKFLRDFTVSFMAAGRDSTSSALTWFFWNLTENPNVLSKILQEINTNLPRTGSDQDMSSYLNKLVYLHGALNESMRLYPPIPFERKSPIKDDVLPSGHKVKSNLNIMIFIYAMGRMKTIWGEDAMEFKPERWISETGGLRHEPSYKFWTVIVEILQNYEIKIVSGQKIEAKPGLVLHMKHGLKSKSLNNHNIDNIISPSAIIPASFLPTNSFPCPSPVIVNKAFNRPTLIRPLPSPSSTLALLSSSSTLALLLSSSFSCLSIDSSSSACASDFYAVLKCKLAYLVIAGGVFISSNQPRWAFADSVLHRLAPLWVGARGLEFTWDYVLQGLEANPNLRPKVVRLSVAGSAIKSSDSRQRPATAISLDPATRKRTGPYFHITFMSNSGIHNISIIYTCAVIIATMPSITSYLKRVNGWHFPKIVGFELATSLVMAFIICQLFILCQRPSL

SEQ ID NO: 19491 - protein, 394 aa, Synechococcus elongatus PCC 6301
MALLETRTEPMVLNMGPHHPSMHGVLRLIVTLDGENVIDCEPVIGYLHRGMEKIAENRSNVMFVPYVSRWDYAAGMFNEAITVNAPEKLANIPVPKRASYIRVIMLELNRIANHLLWLGPFLADVGAQTPFFYIFRERELIYDLWEAATGQRLINNNYFRIGGVAADLPYGWLEKCIDFCDYFQAKVDEYERLITDNPIFRRRVEGIGVISREEALNWSLSGPMLRGSGVKWDLRRVDHYECYDDFDWDVITAEEGDCFARYRVRVQEMRESLKIIRQACAGIPGGPYENLEARRMAEGKKSEWYGPDYQYVSKKVAPTFKIPAGEHYVRLESGKGELGVFIQGADDICPWRFKIRAPDFNNLQILPQLLQGVKVADIMAILGSIDVIMGSVDR

SEQ ID NO: 19492 - protein, 503 aa, Yersinia pestis biovar Medievalis str. 91001
MFVPQPSNKPLSLMLAGLSVKKTAADSFMKCVVYSHQCVISATEGRMEQQLQNSSLKRGLKNRHIQLIALGGAIGTGLFLGIAQTINMAGPSVILGYAIGGFIAFLIMRQLGEMVVEEPVAGSFSHFAYKYWGDFAGFLSGWNYWAMFILVGMAELTAVGIYIQYWWPEIPTWVSAAVFFIIINAINLVNVRLYGETEFWFAIIKVAAIIGMIVFGAYLLASGSGGPAASVTNLWAQGGFMPHGFRGLIMAMAVIMFSFGGLEMVGITAAEAEDPRNSIPKATNQVVYRILIFYIGSLTVLLSLFPWNNVVEGGSPFVMIFDALDSPWVATALNVVVLTAALSVYNSGVYCNSRMLFGLASQGNAPKLLTKLNKRGVPIRSIALSALATSAGVVINYIMPGKAFELLMALVVSTLVINWVMICLAHLKFRKAKVKEGVVPRFKALWYPYGNYLCLVFLALILVIMYLTEGIRISVLMMPVWIALLWCGFVLTRRKCPKTVTSL

SEQ ID NO: 19493 - protein, 339 aa, Synechococcus elongatus PCC 6301
MTIRVAINGFGRIGRNFLRCWFGRQNTDLEVVAINNTSDARTAAHLLEYDSVLGRFNADISYDENSITVNGKTMKIVCDRNPLNLPWKEWDIDLVIESTGVFVTAEGASKHIQAGAKKVPITAPGKGEGVGTYVIGVNDSEYRHEDFAVISNASCTTNCLAPVAKVLHDNFGIIKGTMTTTHSYTLDQRILDASHRDLRRARAAAVNIVPTTTGAAKAVALVIPELKGKLNGIALRVPTPNVSVVDLVVQVEKPTITEQVNEVLQKASQTTMKGIIKYSDLPLVSSDFRGTDESSIVDSSLTLVMDGDLVKVIAWYDNEWGYSQRVVDLAELAARKWAA

SEQ ID NO: 19494 - protein, 459 aa, Bacillus cereus G9241
MIQKQHESKLEVGQTFPVTIKRLGINGEGVGYFKRQVVFIPGALPGEEVVAETTKIQRGFAEAKVKKVRKASPHRVKAPCPVYEECGGCQLQHLDYKEQLNQKRDIVVQAFEKYMKNSLEEKIRPTLGMENPWHYRNKSQLQVGRKDEKVITGLYKQNSHQLIDIAHCMIQHKATNEATKVVRRILEKLNVSIYNEKKQKGLVRTIVTRTAVQTGEVQVTLITTKEELPNKEQFIAEVQKQMPAVKSIMQNVNWRKTSVIFGDKTFKLAGKEVIQETLGDLSFELSARAFFQLNPEQTVVLYNEAKKAAALTGNEKIVDAYCGVGTIGLWLANDAAEVRGMDVIPEAIADARKNAKRHGFTNTKYEAGKAEQWLPKWVKEGWRPDVIVVDPPRTGCDDKLLETILKVKPKQVVYVSCNPSSLARDVQALMKSYEVEYVQPVDMFPHTAHVENVVKLVRK

SEQ ID NO: 19495 - protein, 473 aa, Bacillus cereus G9241
MMDQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAALLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKGSNLEHIEKTKTTEIESL

SEQ ID NO: 19496 - protein, 501 aa, Arabidopsis thaliana
MGELQDWSVTTCLLLLLFQASQIHCTSQTHVLNRLLYRSKRGFGSSVDTNHLNAIRHLSVSSPQNTSGVNQQEQKERDLIENLPGQPSVSFRQYGGYVTVNESAGRSLYYYFVEATKTKKSLPLVLWLNGGPGCSSLYGAFQELGPFRIYGDGKTLYTNPYSWNNVANILFLESPVGTGFSYTNTESDLENPGDMKAAADKYIFLVKWLERFPEYKGREFYIAGESYAGHYVPQLAQTILVHNKNQNFINLRGILIGNPTLNDIVETTGSFDYLVSHALLSQDSLLSYKENCATDTPKMEVDCIALSMKIDDDIKKMNLYNILTPTCINATLTPLTNQSKECTTVLQYEPCGMQYIAAYLNREDVQRSMHVTKLPHTWMLCNEATGFNWNQTDYSASMLPILKELMKHDQLRVWVYTGDTDTVIPLTVTMHALKMMNLTAVTDWLPWFSEGQVGGFTEEYKGNFRYATVIGAGHEVPLYKPKAALTLFKHFIRNSPLPLTP

SEQ ID NO: 19497 - protein, 367 aa, Rhodobacter sphaeroides 2.4.1
MSHSKTEYSDAISSIEEIIDDARNGRMFILVDHEDRENEGDLVIPAQMCTPAAINFMATHGRGLICLALPSARIDQLGLHLMTPKNSSRHETAFTISIEAREGVTTGISAADRARTVAVAIDPSKGPADIATPGHVFPLRARDGGVLVRAGHTEAAVDVSRLAGLNASGVICEIMNDDGTMARLPDLVAFAQRHGLKIGTISDLIAYRRRHDNLVKEKAVKHVTSCYGGDWLMRIFSDDTQGAEHVILSKGNVTDGEPVLVRMHALNPLEDVLGIGPAHAGDLHGAMRLIAQEGRGVVVLLRDVTMKLPMDDEASPQTLRQYGLGAQILSALGLSQIVLVTNSRAPKVVGLEAYGLSIVGTHHISEV

SEQ ID NO: 19498 - protein, 404 aa, Zea mays
CIHVADTPTLDALKKAAPERWRLIKAHGTAVGLPTDDDMGNSEPVTTCSAKLVDLALGSGKIYEGEGFKYIQQSFQDGTLHLIGLLSDGGVHSRFDQLQLLLQGASERGAKRIRVHVLTDGRDVADGSSVRFVEMLEEDLARLREKGVDARIASGGGRMYVTMDRYENDWQVVKRGWDAHVLGEAPHRFRSALEALRKLREEDPKKASDQYLPPFVVVDGSGEPVGPVRDGRRPWFDRVRFPRTRYAGMLQYDGELKLPRHYLVAPPEIQRTSGEYLARNGVRTYACSETVKFGHVTFFWNGNRSGYFDQNLEKYEEIPSDAGIPFNVQPKMKALEIAQKARDAILSQKFDQIILDAVEQVGGVFVVTADHGNAEDMAKRDKSGEPLRDKDGKVQTLTSHTLNP

SEQ ID NO: 19499 - protein, 337 aa, Zea mays
MGKIKIGINGFGRIGRLVARVALQSEDVELVAVNDPFITTDYMTYMFKYDTVHGQWKHSDITLKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 19500 - protein, 400 aa, Rhodobacter sphaeroides 2.4.1
MAFLSDTLARVKPSQTIAVTNKARELAAAGRDVIGLGAGEPDFDTPDNIKAAAKRAIDAGRTKYTAVDGIPELKRAICEKFERENGLKYTPAQVTVGTGGKQILYNALVATLNPGDEVIIPAPYWVSYPDMVLLAGGTPVSVAAGMETGFKLTPEQLEAAITPRTKWFIFNSPSNPTGAAYTRAELAALCEVLMRHPQVWIMSDDMYEHLVFDDFDFTTPAQIEPGLYDRTLTCNGVSKAYCMTGWRIGYAAGPVELIRAMGTIQSQSTSNPCSIAQYAALEALSGPQEFLATNREAFQRRRDLVVSMLNEAKGVTCPNPEGAFYVYPDISGCIGKTSAGGAKITDDEAFASALLEETGVAVVFGAAFGLSPNFRISYATADEVLREACARIQAFCAGLS

SEQ ID NO: 19501 - protein, 922 aa, Aspergillus nidulans FGSC A4
MASAGPATADGGAGHSHAASGHHLHATNVQSKRRTMIATPTGQWSLGKTLGAGSMGKVKVGKHLETGEQVAIKIVPRQSTEEHRSQREAERADRSKEVRTAREAAIVSLVNHPYICGMRDVVRTNYHWYMLFELVNGGQMLDYIISHGKLKEKQARKFARQIASALDYCHRNSIVHRDLKIENILISKTGDIKIIDFGLSNLFSPRSLLKTFCGSLYFAAPELLQARQYTGPEVDVWSFGIVLYVLVCGKVPFDDQSMPKLHAKIKSGVFEYPPGLTAECRHIISRMLVTDPKQRASLTEIMNHPWMNKGFSGPPDNHLPHREPLQLPLDPEVIEKMTGFEFGKPEYITAQLTKIIESEEYQHAIALNAREHPVPAHTDKKRGVFDFYKRRNSASRDTLSAPSAEAVQLGNDPLNAYSPLLSVYYLVKEKLDRERSESNPGALSIAQAPGDMLQVPDLAPPEAAHTNQYQVPGEKDTGRRSRPRARTHGDDEITEGMKNASLAPNHAQASHSPAASQPDTPAKKESTAAGLLRRFSTRRTKDRSRDRERSRLASPHQPSLNVQPPADSASPLSRGFSMRKNRRTEPSATAIPSTGSQPQHQDLLKTPGSVEPASRSNKYLERSISVSSGEPRHRRSRRTEGDSGSQPPQTSGSEYSAVPKDSTAGREQKIAPRTHASRTMSLGHARRESIQARRARRDAAREANVPEETDGEISGPGAALESANEEDLSKPVYLKGLFSVSTTSSKPLAFIRADIIRVLKQLAVDYVEIKGGFSCRHAPSIELDKVVDNGPPSPERQGQVSNHRRRISLGGLLNHDDGREELARTTTRRRHRAPDRSFVSNSEVSDEYLETRDTTVTSGERVVGETTTRVQSDTGGNLVLRFEILIVKVPLFSLHGIQFKKVSGGMWQYREMAKKILDALRL

SEQ ID NO: 19502 - protein, 264 aa, Bordetella bronchiseptica RB50
MRQALFLGYGRMGAALGEAWLRAGLLAGIDAVDPGRDGAGLRARLVRGADELPEQAYDLVVLAVKPAMAQQALRAVPPARLARACLVSIMAGVPAGALRQALQPPRPVARAMPNTPVMAGQGCTGLYGGDDVAPAQRAAIGRLFEAVGAAFWVDTEDQLHAVTALSGSGPAYYHLFSEALAQAGEQLGLPAALARSLAARTALGAASLQCEEGADFAALRREVTSPHGTTHAAIEVFEQAGALRTLVRDAVRQAQARSRELARP

SEQ ID NO: 19503 - protein, 399 aa, Candidatus Pelagibacter ubique HTCC1002
MSIISDSLKKIKPSPTIAVTQKARELKAAGKDVIGLGAGEPDFDTPDNIKQAAIKAINDGDTKYTAVDGTAALKDAIVKKFKRENNLDYTTDQITVGAGGKHVIYNAMMATLNEGDEVIVPAPYWVSYPDMVLLAGGTPIILECNEKQGFKINPAKLEKSITPKTKWIILNSPSNPTGACYTESDIKEIAYVLANHPHVHILSDDIYEHVTYEGFKFFTIAQIDGLKERVLTMNGVSKAYSMTGWRIGYAAGPKDIIKAIAKIQSQSTTNPSSISQAAAVEALNGTQDFIKERATSFQERRNFVVKALNGIDGIECLNPDGAFYVFPSCKGLMGKKDTSGKELKTDTDFVQSLLENSGVAVVQGSAFGLEGFFRISYATSMDNLKKALEKISTFCKSLN

SEQ ID NO: 19504 - protein, 340 aa, Cyanidioschyzon merolae strain 10D
MAVPKVGINGLGRIGRLVLRAAVEKGTVEIVAVNDPFIFSDVSYAAYSLKYDSTHGAFPGEIGTDGEHLVINGKKITCFAIRDPADIPWASTGAEYVVESSGAFTTAEKASLHLKGGAKKVVVSAPAKDVPMFVMGVNHDSYTKDLQVVSNASCTTNCLAPLVKILDEAFGIENGLMSTIHAVTATQRTVDGPSNKDWRRGRSAMLSIIPSSTGAAKAVGKVYPKLDGKLTGMAFRIPVALVSVVDLTANLKTPTTYEEIKHVMKAAAENPEFKGIFGYTEDPIVSADLAHSSYSSVFDAQAGIMLSPTFVKLVSWYDNEWGYSNRVVDLITHMAKVDAA

SEQ ID NO: 19505 - protein, 479 aa, Myxococcus xanthus DK 1622
MDAKGLRTFLEIPYDELEERNLKVKEQRLKHTASEKLRDERIEYLTKERAIKAVTVCFTDLEGRLHMLDYDKKFLIKSADNLTFDGSSIRGFSAQQESDLRLNIDWSAFYWLPSDIFGPGKVLVFSEVHERDGTQYHSDLRGRLKLLTESMYQKDGTVVHAAPEIEGFLFKGRDAEHHFHEKGHFDFISTGGYYHSLPGDVLRTFIDKVAEAQRAMGFQNEKDHPEVAPSQFEINFSYSEALIAADQIQLYKLLSRQVAAQLDCTASFLPKPVTGVNGNGMHMNLSLSKGGKNLFHDQNGPDGLSPMGWDFIDRLLTSANDICLTLNSSVNAYRRLDPHFEAPNQIKASANNRGAMVRIPFGNERSARIECRSVAPDANPYLVLYTLLRTGLEGPQPQEDAEAKRSRTRFLPDNIFDAIRIFKGSQFVASILGEGVQSKFAELKTTTAERSPKQLGTRVKYSEVKFHHEVTNQFLWNQF

SEQ ID NO: 19506 - protein, 317 aa, Xylella fastidiosa 9a5c
MDERVLLTCLGCSYVSGNVLASMTGMTEATIAACIQALRAVGIPIKSRAEQGYALAAPLSLLNAERIRAELSHSIAAELRVLDVAWTLESTNTSLLARPALADGVEVLLAERQTGGRGQRGRIWISPLAANIYLSLSRVFSSGAAQLMGLSVAVGVAIAEALIAAGFSHVRLKWPNDLVDNDRKLGGVLVERQGEARAVIGLGLNVRMPTNFAEQIDQPWVDLETLAGSTVERNALVALLLSALLPALHLFQLEGLAPFLPRYAKLDCLVGCAVWIEEANLKYVGIARGLAADGALLVEINGVLRPFHTGQVSVRPI

SEQ ID NO: 19507 - protein, 304 aa, Desulfovibrio vulgaris subsp. vulgaris str. Hildenborough
MLTAGLADVAAPLSLDELDRSGFLGPLFESFGCPAGAQPRAFSAGQGVGCSHDGEWDVLELAAGNETLFLCGDATSSLDVARILTDRGALPEWGMVLVLSQSAGRGQLRRPWVSPRGNVYAALRLPADPPFTADYAALSVGCMLAEGFRTLGIPVQLKWPNDILLDDCKVGGILLEERAGIIIAGIGINCTFAPPVAQLRDGWAVRAASLLEKGYDLTPLALFASLVKNGRFWYLNEIRRAGHGAFPSCAERHLAWMGRGIVVHGGDVDDKPGRIAGLSSEGGLRVRFPDGERVILSGSIVPGS

SEQ ID NO: 19508 - protein, 480 aa, Brucella melitensis biovar Abortus
MQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDAAIMNEEPFGPVALLNRFDALDEALSEANRLNYGLAAYAFTGSSAKAARISSTVRSGMITINHYGLALPEVPFGGINDSGYGTEGGADALEAYQNTKFVSFLQA

SEQ ID NO: 19509 - protein, 371 aa, Ralstonia metallidurans CH34
MTISRIEDIIADIRAGRMVILVDEEDRENEGDLVLAADFVTPEAINFMAKYGRGLICLTLTAERCRQLELYPMVSRNGTVHGTNFTVSIEAAEGVTTGISAADRSRTVQAAVARDARASDLVQPGHIFPLTAQPGGVLIRAGHTEAGCDLGTLAGLTPAAVICEIMKDDGTMARLPDLIEFAREHDLKIGTIADLIHYRSRTESIIERVGERDMQTPWGTFHSVLYRDKPSGRAHVALVKGKPQPDRETLVRVHEPLSVLDLLEAGHTTHSWSLPAALEVLHGAEHGVMVLLNCGDSPEMLFEQFAALDAPENRPRRKPDLRTYGVGAQILRDIGVGKMRVLGSPQKMPSMTGYELEIVGCQPMSGESNRG

SEQ ID NO: 19510 - protein, 215 aa, Buchnera aphidicola str. APS (Acyrthosiphon pisum)
MNQTLLSKFGKPIERIKNAILALKSGQGVIILDDEERENEGDLVFACENMTVEQMALSIRYGSGIVCLCITESKRKQLNLPMMVKKNTSAYRTGFTVTIEASKGISTGVSAKDRLTTIKTAIADDAKPSDLNRPGHVFPLRAHKGGVLSRPGHTEAAIEIVSLAGFKPAGVICELTNKDGTMARTPEIIKFSENKKMQVLTIQDLIFYIKNINHL

SEQ ID NO: 19511 - protein, 158 aa, Glycine max
  misc_feature (46)..(46): Xaa can be any naturally occurring amino acid
  misc_feature (92)..(92): Xaa can be any naturally occurring amino acid
  misc_feature (108)..(108): Xaa can be any naturally occurring amino acid
  unsure (1)..(158): unsure at all Xaa locations
FLILISKQRLPHDHFPTVTTVNRAGAGLDAPLTGLKSMAGFPTRKXTNNDITSLASNGGRLQCMRGWPPGGKNNLETLSYLPDLDDAQLPKXVEYLLRKGWIPCLEFXLEHGFESREHTRKPGYYHGRYWTMWKLPMFGCTDAPEVLKELQEANTAYP

SEQ ID NO: 19512 - protein, 393 aa, Ralstonia metallidurans CH34
MDLQRLATASRLANIDAFHVMELAKQAAELERAGRHIIHMGIGEPDFTAAAPVIHAAEAAMRRGVTQYTGALGIHALREAIAGYYKTSYGIDVPARRVIVTAGASGALLLACAVLVEIGAEVLMPDPSYPCNRHFVAAFDGHAKMIPSGPEERFQLTAAQVIEHWGENTRGVLLASPSNPTGTSILPDELKAILAEVRKRQGFAILDEIYQGLSYDAPPVSALSLDDNVVTVNSFSKYFNMTGWRLGWLVVPDSLVPAFEKVAQNLFICASAVAQHAALACFTPEALAIYDERKAEFRRRRDAIVPALEALGLRVPVKPDGAFYVYANCRHVNHPAAGNADRLTQAILHDAGVVMVPGTDFGPHTANDYIRISYATSMQNIEEAMQRLHHFLR

SEQ ID NO: 19513 - protein, 337 aa, Desulfovibrio vulgaris subsp. vulgaris str. Hildenborough
MPEVTVTEHLLLHQKKSPAATGQFTTLLNDLVLSAKIISRSVTKAGLLDVLGGTGEVNVQGELVQKLDEFANRVLIYRMERSGAVCAMASEENADIIKVPEKLHRGDYVLIFDPLDGSSNIDVNINVGTIFSILRRKSPASDDVCIDDVLQPGYEQVAAGYILYGPSTMLVFSTGQGVHGFTLDPSVGEFLLSHPDMSIPERGRIYSINESYWNYWDEPTREIVSYFKGDHNERGKPYSLRYVGSLVADFHRTLLYGGIFMYPMDYRHPDKPQGKLRLMCEASPLAFLAEQAGGRAIDGSRRILDVCPGTLHERIPLFIGSARDVDKVEEIYARHRA

SEQ ID NO: 19514 - protein, 131 aa, Hordeum vulgare subsp. vulgare
PNLLELEAPIKICGDIHGQYSDLLRLFEYGGFPPEANYLFLGDYVDRGKQSLETICLLLAYKIKYPENFFLLRGNHECASINRIYGFYDECKRRFNVRLWKVFTDCFNCLPVAALIDDKILCMHGGLSPDL

SEQ ID NO: 19515 - protein, 1098 aa, Xanthobacter autotrophicus Py2
MLEPVTAGDDPLWYKDAIIYQLHVKSFYDANDDGIGDFRGLISKLDYIADLGATAVWLLPFYPSPRRDDGYDISLYEGVSPDYGTMDEARRFIAEAHARGLRVITELVINHTSDQHPWFQAARRAPKGSPERNFYVWADDDKGYPGVPIVFCDVEKSNWTYDEVAGQFFWHRFYSHQPDLNFDNPEVLERVLSIMRFWLDLGVDGLRLDAVPYLVEREGTDCGNLPETHAILKQIRAHLDAHYTGRMLLAEANLWPEDTQQYFGADADECHMAFHFPIMPRMYMAIAKEDRFPITDILRQTPEIPPTCQWAIFLRNHDELTLETVTDSERDYLWSVYAADRRARINLGIRRRLAPLLERDRRRMELMNSLLLTLPGTPVIYYGDEIGMGDNIHLGDRDGVRTPMQWSPDRNGGFSRADPERLVLPVIQDPLYGYGAVNVEAQLRDSHSLLNWTRRFLAVRRQHAAFGRGTFRQLFPRNRRILAYLRELEGEAVLCVANLAHTLQAVELDLADFERRVPVDLVSGTTLAALGRAPLILTLPPYGFYVFNLSQTAAEPSWRDPAPEALPEFATLVVREGLMGALSEQHRAVIENEALPGYLARRRWFQGRAQDIGATRLGWAMRLPGTERDVVLAEVEADIAGATERYLMPLCIAWEDQHPPAIAEQLALTRVRQGRRVGFLTDAAVLDGLAAGVVRSLREEAPVELPDGGAIVFSRTSHLDGVTVERGAPAQFIDADEPAANLVVTDRVAVKLFRHMKFGHTAEEEMARHLSTLGLPQVPPLLGAVTRTDRAGARAPLALVYGRMQHQGNAADWTMTQLQRALDTAASTVDGARQRFEDEIAGMMALVRNMGRRLGELHAALSAPTDATGFTPQDADAELRALWLSRAEAAYSAALDALDRLPAPDGARQSRRAELEGMRAALNERLGVLYSGTPLPLIRIHGRCDLHHMLVAGGDALIVGALGGLEGVQEGERAPQSPWRDVAELLAALERAAARIGGGETGAARDAPQLRAELIAAFLARAERAVLGAYLERAPTIATASRPLAEAFNLEALARAVVAERERPRCVHALASALHRQTARLLKTADAEEAAALARGPS

SEQ ID NO: 19516 - protein, 344 aa, Arabidopsis thaliana
MASSDFDGILLGMGNPLLDVSAVVDQQFLDKYDIKLNNAILAEDKHLPMYDEMSQKFNVEYIAGGATQNSIKVAQWMLQVPGATSYMGSIGKDKYGEAMKKDATAAGVYVHYYEDEATPTGTCGVCVLGGERSLIANLSAANCYKVEHLKKPENWALVEKAKFYYIAGFFLTVSPESIQLVREHAAANNKVFTMNLSAPFICEFFKDVQEKCLPYMDYIFGNETEARTFSRVHGWETDDVEQIAIKMSQLPKASGTYKRTTVITQGADPVVVAEDGKVKKYPVIPLPKEKLVDTNGAGDAFVGGFLSQLVHGKGIEECVRAGCYASNVVIQRSGCTYPEKPDFN

SEQ ID NO: 19517 - protein, 130 aa, delta proteobacterium MLMS-1
MNWKRLFSRTESLDPAEARNFMDQRSAADYQLLDVRQPKEYEAAHLPGARLIPIKELAQRRAELDPARPVLVYCAVGGRSRAAAQYLNGQGFKEVYNMAGGIKAWDGGKAAGPVEAGLELLPAEAEYDEA

SEQ ID NO: 19518 - protein, 433 aa, Azospirillum brasilense
  misc_feature (380)..(380): Xaa can be any naturally occurring amino acid
  misc_feature (431)..(433): Xaa can be any naturally occurring amino acid
  unsure (1)..(433): unsure at all Xaa locations
MSDISNVFDLIKEHDVKYVDFRFTDPRGKLHHTVQHVSTIDEDVFEDGIMFDGSSIAGWKAINESDMILQLDPTTAVMDPFSAQPTLNILCDVYEPSTGQPHARCPRGIAKAAEKHMASAGIGDTAYFGPEAEFFVFDDVKFKVEMNKVSYEFDSEEGPYTSDKDYEDGNLGHRPGVKGGYFPVAPVDSGSDLRAEMLSVLAEMGVPVEKHHHEVAASQHELGIKFDTLVRTGDNMQYYKYVVHNVAHAYGKTATFMPKPVFGDNGSGMHMHQSIWKEGQPLFAGNQYADLSELALYYIGGIIKHAKALNAFTNPTTNSYKRLVPGYEAPVLLAYSARNRSASCRIPYVASPKGKRVEVRFPDPSANPYLAFAALLMAGXDGIQNKIHPGEAMDKNLYDLPAEELAKVPTVCGSLREALDSLKADSAFLQXXX

SEQ ID NO: 19519 - protein, 270 aa, Saccharophagus degradans 2-40
MVYTATPLEKKVTVNTLRKMKADKEKFITVALYDAPMAAMAQKCGVEVVLIGDSLGMTVLGYDSTVPVTMEQMIYHIEAVARGNSRSLIIGDLPFMTYATVEQTMINATRVMQAGAHMVKMEGGAWLVDSVRMLSERGIPVCAHLGLTPQSVNKFGGFRVQGRSEEQGEQIIADALALEEAGADLLVLECIPAELGARVTQALSIPTIGIGAGIGTDAQVLVINDILGLTEFPPKFSKNFLLEAKDIPGALQKYAADVKSGVFPGPEQQF

SEQ ID NO: 19520 - protein, 212 aa, Calystegia sepium
GHKEFDYFTLALTWSGTECLSVKDSCPTNACSRSEVETGFTIKGLWPDYDDGTWPSCCEGAKYDQNEISILSNDLSKYWPSYSCPSSSACGSFDASDLAYEWAKHGTCSSPVLGNQYEYFSTTLMLYFKYNISEILSESGYLPSNTAEYKVEGIMSAIQSALRVTPVVKCKSDAVEQVQICFDKTLQLQECPSTASTCPSLVSLPIKNTIKP

SEQ ID NO: 19521 - protein, 475 aa, Corynebacterium glutamicum ATCC 13032
MDRRTKIVCTLGPAVASADGILRLVEDGMDVARLNFSHGDHPDHEQNYKWVREAAEKTGRAVGILADLQGPKIRLGRFTDGATVWENGETIRITVDDVEGTHDRVSTTYKNLAKDAKPGDRLLVDDGKVGLVCVSVEGNDVICEVVEGGPVSNNKGVSLPGMDISVPALSEKDIRDLRFALKLGVDFIALSFVRSPADAELVHKIMDEEGRRVPVIAKLEKPEAVTSLEPIVLAFDAVMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRVARLHSHLPLLVFTPNEAVRSELALTWGATTFLCPPVSDTDDMMREVDRALLAMPEYNKGDMMVVVAGSPPGVTGNTNMIHVHLLGDDTRIAKL

SEQ ID NO: 19522 - protein, 279 aa, Crocosphaera watsonii WH 8501
MPFIQWYPGHIAKAERQLKEQLNRVDVIFEVLDARIPLASHHPDVPGWIGDKPRLVVLNRTDMIPESVRQGWLNWFAAQGETLYCTNAKQGKGIKALKKAAQAAGVQMNERRQQRGMRPRAVRAVVIGFPNVGKSALINRLLGRKVAASARRAGVTRQLQWIRISDALELLDAPGIIPAKLENQEDAVKLAICEDIGEAAYDNQQIGAALIDLLVELNFDNILSSRYQLDPQNITGEEYIESLGNSKFKGDTERATMQLLNDFRKGVMGKIPLELPQLI

SEQ ID NO: 19523 - protein, 605 aa, Gloeobacter violaceus PCC 7421
MRVGADVFVLDANAQQTTAAPSERARFRRTKIVATIGPAVDDPQALRKLIQAGATTLRLNFSHGNHEEHRRRIGLIRQISFELNQPVAILQDLQGPKIRLGKFADGPIVLKHGDPFILTSHDVPANQHISPITYSRLIQEVPTGATILLDDGRVELVVERVDLEAQYLHCRTVGGGKLSNSKGVNFPGVTLSVPAMTEKDREDLLFGLNQGVDWVALSFVRTPSDLLELKELIAQSGKRVPVIAKIEKFEAFENLDAVIAACDGLMVARGDLGVEMPAEEVPLLQKRLIASANRAGKPVITATQMLDSMVSNSRPTRAEVSDVANAILDGTDAVMLSNETAVGEHPILAVETMARIADRIERSMPQRTWVDTGRSIPNAISQAVGSVAQQLGAQAILTLTKSGATARNVSKYRPRVPIIAITPSVSVARELQMVWGVYPLMVLDLPSTRQTFQAAISAAQDENLVLEGDLVVMTAGTIQGLSGSTDLIKVEVVTAILGRGLGLGQNAVSGRARIVRHSDEAAALSPGDILIAPRTDANFIEAIKLAGGIVTEESGLTSHAAIIGLRLGLPVLLGVKDCTTRIPDGVVLTLDPQKGVIFSGAASAV

SEQ ID NO: 19524 - protein, 473 aa, Arabidopsis thaliana
RISIDFFTSHKKKVSAFISLMGVALLTLTASLDTLRPRPCETASILCQSPSKTQLGVLYTAITLASIGTGGTRFTLATAGANQYEKTKDQGSFFNWFFFTTYLAGAISATAIVYTEDNISWTLGFGLSVAANFFSFLVFVSGKRFYKHDKPLGSPFTSLLCVIFAALRKRKAVVSTNEKDYHNESITMPTKSFRFFNRAALKQEDEVKPDGTIRNPWRLCSVQQVEDFKAVIRIIPLALATIFLSTPIAMQLSLTVLQGLVMDRRLGPSFKIPAGSLQVITLLSTCLFIIVNDRVLYPFYQKLTGKHLTPLQRVGIGHAFNILSMAVTAIVEAKRLKIVQKGHFLGSSSVADMSVLWLFPPLVIVGIGEAFHFPGNVALCYQEFPESMRSTATSITSVVIGICFYTSTALIDLIQRTTAWLPDDINHGRVDNVYWILVIGGVLNLGYFLVCSWLYRYRNLKDDDHKQAANVSH

SEQ ID NO: 19525 - protein, 585 aa, Bacillus cereus ATCC 10987
MRKTKIVCTIGPASESIEKLEQLIEAGMNVARLNFSHGSHEEHGARIKNIREASKKTGKTVGILLDTKGPEIRTHDFVDGQAELVTGAEVVISTEQVLGTAEKFSVSYAGLYDDVNPGSRILIDDGLIELEVIEKADGNIRTKVLNSGTVKNKKGVNVPNVSIKLPGITEKDVKDIIFGIEQKVDFIAASFVRKAADVLEIRELLEEHNAQYIQIVPKIENQEGIDNIDSILEVSDGLMVARGDMGVEIPPEEVPLVQKRLIKKCNVLGKPVITATQMLDSMQRNPRPTRAEASDVANAIFDGTDAIMLSGETAAGQYPVEAVTMMANIAVRVEKSLQYEDMFKKRIKEFTPTITDAISQSVAHTALALDVAAIVAPTESGYTAKMISKYRPKSPIVAVTSDEQVGRRLALVWGVQAFMAEKRAASTDEMLDTAIQTGMDAGLIGLGDTVVITAGVPVAETGTTNLMKIHVVGEEVAKGQGIGRKAAKGKVVVAKTAAEAVANVNEGDILVTTSTDKDMIPAIEKAAALVVEEGGLTSHAAVVGVSIGIPVIVGVNGVTATLKNGQEVTVDAARGIVYNGHAEVL

SEQ ID NO: 19526 - protein, 504 aa, Bacteroides thetaiotaomicron VPI-5482
MSKKALLMILDGWGLGDQKKDDVIFNTPTPYWDYLMNNYPHSQLQASGENVGLPDGQMGNSEVGHLNIGAGRVVYQDLVKINRACADNSILQNPEIVSAFSYAKENGKSVHFMGLTSNGGVHSSMVHLFKLCDISKEYGIDNTFIHCFMDGRDTDPKSGKGFIEELSAHCEKSAGKIASIIGRYYAMDRDKRWERVKEAYDLLVNGQGKKATDMVQAMQESYDEGVTDEFIKPIVNANCDGTIKEGDVVIFFNYRNDRAKELTVVLTQQDMPEAGMHTIPGLQYYCMTPYDASFKGVHILFDKENVANTLGEYIASKGLNQLHIAETEKYAHVTFFFNGGRETPFDNEDRILVPSPKVATYDLKPEMSAYEVKDKLVDAINENKYDFIVVNFANGDMVGHTGIYEAIEKAVVAVDACVKDVIEAAKAQDYEAIIIADHGNADRALNEDGTPNTAHSLNPVPCVYVTGNKAAKVEDGRLADVAPTILKIMGLEAPADMNGQILIK

SEQ ID NO: 19527 - protein, 299 aa, Pseudomonas aeruginosa UCBPP-PA14
MAGQDLSGKTAIVTGGYSGLGLETTKALAYAGARVIVTARRPDVAREALLGLDEVEVQALDLAELACVRRFAEAFSASRRRADIVINNAGVMACPETRVGPGWEAQFATNHLGHYALVNLLWPSLADDARVVAVSSAGHHYSAIRWDDVQFERGYDKWLAYAQSKTANALFAIQLDALGRERGVRAFAVHPGSIATPLQRHVPRAEMIALGWMDEAGNPASPDTLKTPQQGAATQLWAATSPLLAGMGGLYCEDCDIAGVAPDDSRTLAGVREHAIDPEQARRLWRLSATLTGIDAFAS

SEQ ID NO: 19528 - protein, 169 aa, Arabidopsis thaliana
MCGLYINLFCLLRITSNKKTMEQTFIMIKPDGVQRGLIGEVICRFEKKGFTLKGLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 19529 - protein, 556 aa, Cryptococcus neoformans var. neoformans JEC21
MPPPSLTSSSTRFRVGLFVFLLAVSLSLTYRFAPSFSSRRSIFPNGKTRPSEYIIDVDVEKLQGQTGKRIAIVGAGASGSSAAFFLRRAASVVERRAGLAESSLISDIIVYEKEGYVGGRTTTIYPHDDDRARPQELGASIFVDSNLNLMKAVKEFNLTLVDPDFGGSGIGIWDGRKFLFTSSSSSWITSARALLRYGPLSPFRTRRAVSSLLKKFLRLYDPSWLHDRGVMYSVEDFAEVVGLGSEYTTRSGESWAKEVVGAGERWIGEVWEGSTRVNYAMNIDKIHALAAGVSMATGGASQVEGGNYQIFQSMLADAGAKLYLGTTVEDIVPQEKDASRKFIVKTNRTELASEEVDHVFWAAPWGLQRMKSLEKEFTEPVPPTPYVRLHVTYLTTTQKHPSPSFFGLPAGSTVPNTILTSAHPPRSPNAPSLPPPRFQSITWHGESFPGSNEYAVKIFSLTRLSDRLLREILGDEPTWVKRKEWNSYPKMEPTARYAPVTLTEGVEYLAGMERWVSTMETQTISAREAVARVAHKWWGLGLGECEDGDSWDWTCS

SEQ ID NO: 19530 - protein, 297 aa, Medicago truncatula
MEGLDGLIERLLEARNNRGKRIQLVESEIRILCTKAKEVFLNQPILLELEAPINICGDIHGQYPDLLRLFEYGGFPPDSNYLFLGDYVDRGKQSIETICLLLSYKIKYPENFFLLRGNHECASINRIYGFYDECKRRFSVRLWKVFTDCFNCLPVAAVVDDKILCMHGGLSPEMESLNQIKAIERPLDVPDQGLLCDLLWSDPDTEVKGWGENDRGVSYTFGPDTVDEFLKKNDLDLICRAHQVVEDGYQFFADRQLVTIFSAPNYCGEFNNAGALMCVDETLLCSFQILKPMRGNK

SEQ ID NO: 19531 - protein, 298 aa, Cyanidioschyzon merolae strain 10D
MFVTLGVPSRAVSSKAESYAQRLRIVRTARTRLFMSAQSARKFFVGGNWKCNGSKQSVQELCEAFNAGKNIDFNRVEVVVAPPSVYAMLTRSILRPDFGVALQNCWVGKPGAFTGEVAVEMIRDIGLSHVILGHSERRHLPEIRESDDVIGRKTKYAIDKGVHVILCIGELLEEREAGRTREVNERQLSAVRAHLSADDWAKVVIAYEPVWAIGTGKVATAAQAQEAHSEIRSWIRRQVSEACASQMRILYGGSVTPENCLELAAQPDVDGFLVGGASLKPTFLDIVRAYQAKETVSV

SEQ ID NO: 19532 - protein, 97 aa, Nicotiana tabacum
MARSFSNSKLISAFVVDTVSSFVSRRGYAAASSASVPGGVRGSGVNIMMKKWEESSKKTTSWVPDPVTGYYRPESHAKEIDAAELRQMLLNHKPRQH

SEQ ID NO: 19533 - protein, 650 aa, Ustilago maydis 521
MAVSTSPSSFKGSKLLLSLLLRSPFRAALLYNRINQAPTVTSKPPTAPLLPRRSFSSGALLVHHSNSLITLSPSRIMSSSRSHSPHLATPSNPSFLSILATSTTTTTTTSSSSTSDSNQSPTTPTKASAAHASGDLDQYLIAPDQAGSVNSALHIQERALHNLTANDVHHSTSTTMGNVSEQSAMDQVLSGVLAMQKELSRLHLRMDEMESKNDVNACRRNSFYNNFTPGQMSPALKSPALFPRLTRAPSSPPKNNGSSDLLHAPHLSMGASAHTQPAPLLAEEPKLGLWAVVPAGGAGTRLWPLSRESYPKFLLDLTGSGRTLLQSTWDRLLPLAGQAQMMIVTGQAHVGGVSAQLPDLEQANVLAEPSPKESMAAIGLAAAVLLQRDPEAVLGSFAADHIISGRDAFESAVTEAVATAKAGYLVTIGIAPSHPSTGFGYIKLGEKLDVSEAPNARRVTEFKEKPDARTASAYLSTGDYRWNGGMFVVKAQVLLDLLKGTVPELHEGLTRIAASWDSDARDTVMSEVWPTLPKIAIDHAVAEPASKVGKVAVVPATFGWDDVGDFASLADLIPAEEGEPRILGDSRLVVTESQAGGLIIPAAGRPIACLGVDDVVVVDTPDALLITTRARSQDVKKIVGRTKKVYPELC

SEQ ID NO: 19534 - protein, 378 aa, Aspergillus oryzae
MAPATLEQENHTRDAEFNRVLHGKSSQAQGGFAAMLGGKDAAAQKAAVDEYFKHWDNKDAAEETEEIRAARRAEYATLTRHYYNLATDLYEYGWGTSFHFCRFAQGEPFYQAIARHEHYLAHTMGIKSGMKVLDVGCGVGGPAREICKFTDANIVGFNNNDYQIQRATRYAEREGLSDKLSFVKGDFMQMSFPDNSFDAVYAIEATCHAPELEGVYKEIFRVLKPGGVFGVYEWLMTDEYDNDNAEHRKIRLGIEQGDGISNMVKVSEGLQAFKNAGFEVLHNEDLADRPDAIPWYYPLAGSFKHMTSPWDFFTIARMTWWGRGIAHRFVGALETIGLAPKGTQKTADSLALAGDCLVAGGEKKLFTPMYLMVGRKPE

SEQ ID NO: 19535 - protein, 472 aa, Escherichia coli
MAGGTGSRLWPLSRELYPKQFLQLSGDNTLLQTTLLRLSGLSCQKPLVITNEQHRFVVAEQLREINKLNGNIILEPCGRNTAPAIAISAFHALKRNPQEDPLLLVLAADHVIAKESVFCDAIKNATPIANQGKIVTFGIIPEYAETGYGYIERGELSVPLQGHENTGFYYVNKFVEKPNRETAELYMTSGNHYWNSGIFMFKASVYLEELRKFRPDIYNVCEQVASSSYIDLDFIRLSKEQFQDCPAESIDFAVMEKTEKCVVCPVDIGWSDVGSWQSLWDISLKSKTGDVCKGDILTYDTKNNYIYSESALVAAIGIEDMVIVQTKDAVLVSKKSDVQHVKKIVEMLKLQQRTEYISHREVFRPWGKFDSIDQGERYKVKKIIVKPGEGLSLRMHHHRSEHWIVLSGTAKVTLGDKTKLVTANESIYIPLGAAYSLENPGIIPLNLIEVSSGDYLGEDDIIRQKERYKHED

SEQ ID NO: 19536 - protein, 181 aa, Brassica napus
MASVMLSSATMASSPAHATMVAPFIGLKSSAAFPVTCKANTKVTSITSNGGRVNCMKVWPPVGKKKFETLSYLPDLTDVEIAKEVDYLIRNKWTPCIEFELEHGFVYREHGNIPGYYDGRYWTMWKLPLFGCTDSTQVLKEVKKCKQESPNPFIRIIGFDNNRQAQCISFFAYKPPSFTDA

SEQ ID NO: 19537 - protein, 598 aa, Arabidopsis thaliana
MLPFSALMYNLATGEKQVLTSWKSYTNPAVGDFVLQITTQVPTQALTMRGSKPYWRSGPWAKTRNFKLPRIVITSKGSLEISRHSGTDWVLNFVAPAHSCDYYGVCGPFGICVKSVCKCFKGFIPKYIEEWKRGNWTDGCVRRTKLHCQENSTKKDANFFHPVANIKPPDFYEFASAVDAEGCYKICLHNCSCLAFSYIHGIGCLIWNQDFMDTVQFSAGGEILSIRLARSELGGNKRKKTITASIVSLSLFLILGSTAFGFWRYRVKHNASQDAPKYDLEPQDVSGSYLFEMNTIQTATNNFSLSNKLGQGGFGSVYKGKLQDGKEIAVKRLSSSSGQGKEEFMNEIVLISKLQHKNLVRILGCCIEGEERLLIYEFMLNKSLDTFLFDSRKRLEIDWPKRFDIIQGIARGIHYLHRDSCLKVIHRDLKVSNILLDEKMNPKISDFGLARMYQGTEYQDNTRRVVGTLGYMSPEDILEIISGEKISRFSYGKEEKTLIAYAWESWCETGGVDLLDKDVADSCRPLEVERCIQIGLLCVQHQPADRPNTLELMSMLTTTSDLPSPKQPTFVVHWRDDESSSKDLITVNEMTKSVILGR

SEQ ID NO: 19538 - protein, 479 aa, Escherichia coli K12
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVAFGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 19539 - protein, 767 aa, Ustilago maydis 521
MPAPSIPPLFAMRASQEQRDSTTVQVLGMDVSSSPSYARTHCNASDGSLTSGTSTPQMQGDYAVTRNYIPSHSSTASRLNKQSSFSTGTSNSPASSEAHEELASLSSRSASQYDSSTFRLAGPSETTSRRSHLNHSNRVLSHKDSFGGSYGMGSGAELSYEPIDEASASPRLARSQKPATSSHDDQPLESHLRTASFPHLHALRSTQQLGSSQSTDGSGGSDLTEPVEVLGRSSAFANLPTSDSLAPRHSTLTTSRSRSALSAAADAASSCDREVADTTFAAKFDHSVSLEPAGRSDACLEKSLGLPTSAIAESSPRSPSISLASKSSERIRDEVTTSAASFAPPSRSTAPLDDTESQPTTQSKHHSSVAPIQASQKKDYHDTDDRDKTTTSSSKRPSSSRARESAAHSGSARADANSSTARPLKSSQRTLPQLPSASGVLPAPPPAMYWSKAPVHGSIPRRSFRAHTANLCDEVLWLFGGCDNRGCFRDLWCFDTETMCWSKPKVTGDIPPARRAHSATMVNKRLYVFAGGDGPHYFNDLYIFDTVSLRWTKPEVGGTAPSPRRAHTCNYYEGQLIVFGGGNGVGALNDVHTLDVNDLSRLEWRKVQCSGKVPIGRGYHTSNLVDGKLIVIGGSDGHMSFNDIHILRLDTRTWYQVKTDEVHNRLGHTATQVGSYLFIFGGHDSKTYTSELLTLNLVNLQWEPRKVCGKRPQGRGYHQAWLRDSRLFVHGGFDGKDIFDDLHFLDLAACAYLPQITSFSVELDDEE

SEQ ID NO: 19540 - protein, 339 aa, Candidatus Protochlamydia amoebophila UWE25
MAVNIAINGFGRIGRLVCRLAIEREDIRIIAINDLVPADNLAYLLKFDSTHGRFKGEIKVEENAIHVNGKKILIFSEKDPQNLPWNDLKIDYVVESTGLFTTSELAGKHLIAGAQRVVISAPAKGDVPTFVMGVNEKNYNPATDRIVSNASCTTNCLAPITKVLLDNFGIDEGLMTTIHAVTASQPTVDGPSKKDWRGGRGASQNIIPASTGAAKAVALCLPQVKGKLTGMAFRVPNADVSAIDLTVRLSKETSYEDICQAMKNASEGAMKGILAFCDEQVVSSDFISSPYSAIFDKDAGITLNSKFYKLIAWYDNEMGYACRVIDLVSYMNCCNNNSL

SEQ ID NO: 19541 - protein, 157 aa, Triticum aestivum
  misc_feature (37)..(37): Xaa can be any naturally occurring amino acid
  misc_feature (52)..(52): Xaa can be any naturally occurring amino acid
  misc_feature (67)..(67): Xaa can be any naturally occurring amino acid
  misc_feature (120)..(120): Xaa can be any naturally occurring amino acid
  misc_feature (133)..(133): Xaa can be any naturally occurring amino acid
  misc_feature (148)..(148): Xaa can be any naturally occurring amino acid
  unsure (1)..(157): unsure at all Xaa locations
HEGKRFLLLSTIPVLIVALAVLVLVNVLDVGTMVHAXALSTISVIVYFCFFXVWGLGLIPNILCAEXIFPTSVRGICIAICALTFWIGDIIVTYTLPVMLNAIGLAGVFGIYAVVCILAXFVFVYMKVPETKXGMPLEVITEFFSVGXAKQGKEATD

SEQ ID NO: 19542 - protein, 981 aa, Xylella fastidiosa Ann-1
MMSHTLSSLRDLEYHGAFVERHIGPNDVEIAHMLRVVGYDSLESLTDAIVPEKIRSTVALDLPKGITEEEALAKIRVIANKNRVFRSFIGQGYYGTHTPKVILRNILENPAWYTAYTPYQAEISQGRMEALINFQTMCADLTGMEIANASLLDEATAAAEAMSLAKRSAKSRSDLFFVHDAVHPQTLELLRTRAEPLGIVLRVGTPEEALQADVFGILLQYPDTFGRIGDHRVLANAVHAQGGLVVVASDLLALTLITPPGEWGADIVVGNSQRFGVPFGFGGPHAGFMACRDIYKRSIPGRLIGVSVDAAGHPAYRLALQTREQHIRREKATSNICTAQVLLAVMASMYAVYHGPQGLLRIAWRTHRMAAILAAALRGAGLTVGEYFFDTLHIVGIDAVAIHCAAAAAGMNLRMIDNAQLGISLDETVTRSDVVALGQVFGVQVDVEALDAITADALPAGLLRSSAFLTHPVFNTHHSEHELLRYLRMLADKDLAMDRTMIPLGSCTMKLNATAEMIPVTWQEFACIHPLAPVVQWSGYRQLIDELEAMLAECTGYDAISLQPNSGAQGEYAGLLAIRAYHRSRGEERRNVCLIPESAHGTNPASAQLCGMQVVIIKCDRSGNVDVDDLRMKAEKYSDTLAALMVTYPSTHGVFEEAITEICEIVHAHGGQVYTDGANMNALVGVAKPGRWGSDVSHLNLHKTFCIPHGGGGPGVGPCAVKAHLAPFLPKTLPLPGDAAGLPVQGTQEAKVGMVSAANFGSASILPVSWMYITMMGAAGLRKATQVALLNANYIAKRLAPHYKTLYTGRHGLVAHECILDVRSLEKVSGVSAEDIAKRLIDFGFHAPTLSFPVAGTLMVEPTESESQQELDRFVDAMIQIRGEIAAIEKGHLDPEDNPLKQAPHTAVQVMASQWEHAYSRELAAFPLGVLHHAKYWPPVARVDNVYGDKHVMCACIPVEAYKEKEDSEIQDLIEEDASRC

SEQ ID NO: 19543 - protein, 236 aa, Escherichia coli O157:H7 EDL933
MGYRSFDTAAAYKNEEGVGKALKNASVNREELFITTKLWNDDHNRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 19544 - protein, 344 aa, Xanthobacter autotrophicus Py2
MKGLVYRGPGKKALEEVPHPRIEQPTDAVVKILRTTICGSDLHILKGDVPTVKPGTVLGHEGVGVIEEVGQAVSAFRKGDHVLISCISSCGRCEYCKRGMYSHCSVAGWMLGHTIHGTQAEYVRIPFADTSLHRIPDGMDEEALVMLSDILPTGFECGVLNGKVQPGSTVAIVGAGPVGLAALLTAQFYSPAEIIMIDLDDNRLEVALTFGATKTVNSGRENAVERVMALTGGIGVDTAIEAVGIPATFVLCQDIVAPGGTIANVGVHGTKADLHLERLWAHNITLTTRLVDTVTTPMLLKTVQSKKLDPQRLITHRFALADILEAYETFEKAAQTRALKVIIG

SEQ ID NO: 19545 - protein, 226 aa, Saccharophagus degradans 2-40
MTQDELKQAVAQAALDYILPHLEDDMILGIGTGSTARLFIDLLAAHKGKFDGAVSSSEASSEQLKGHGIPVYDLNSVDSLPFYIDGADEANAQLHLIKGGGAALTREKIITAVADKFICIADASKDVDVLGKFPLPVEVIPMARAHVAREIVKLGGNPVHRQDCVTDNGCQILDVYDLAIHDAPALEAKLNNIAGVVTNGLFALRPADVLLLGTTNGVETRFAAKP

SEQ ID NO: 19546 - protein, 411 aa, Saccharophagus degradans 2-40
MTDSKTSLNKDKIKFLLLEGVHQSAVDSLKNAGYTNIEYHKAALNEDELIEAIKDAHFVGLRSRTQLTRKVFENAPKLVAAGCFCIGTNQVDLQAATEHGVAVFNAPYSNTRSVAELVIAEAILLLRGIPAKNAGCHRGEWQKSAEGSFEIRGKTLGIIGYGSIGSQMSVLAESLGMRVFFYDVINRLPLGNAVQCKSLNELLAKSDVVSLHVPETGATKNMIGEREINAMKKGAILLNASRGTVVDIDALAAAMESGHIAGCAIDVFPVEPKGNNEEFQSPLRAFDNAILTPHIGGSTMEAQENIGFEVAEKLVKYSDNGTTITSVNFPEVALPSHDKVHRLLHVHKNVPGVLTAINKIFSESDINICGQYLQTNDKLGYVILDVDRAYSEMALEQLRKVTGTIRCRVLF

SEQ ID NO: 19547 - protein, 482 aa, Salmonella enterica subsp. enterica serovar Paratyphi A str.
MQLNDSTLFRQQAFIDGDWRDARGGDVIPVSNPANGKPLGNVPKMGAEETRDAINAANRALPAWRALTAKERANILRRWFNLMMEHQDDLARLMTLEQGKPLAEAKGEISYAASFIEWFAEEGKRIYGDTIPGHQTDKRLLVIKQPIGVTAAITPWNFPSAMITRKAGPALAAGCTMVLKPASQTPFSALALAELAQRAGIPAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQEHIADALEKGARVITGGEAHKLGGNFFQPTILVDVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 19548 - protein, 140 aa, Xanthobacter autotrophicus Py2
MAIERTFSIIKPDATRRNLTGAVNAVIETAGLRIVAQKRILMTKAQAETFYAVHSARPFFGDLVSFMTSGPVVVQVLEAENAVAKYREVMGATNPANAAEGTIRKLLAESIEANSAHGSDSVENAAVEIAQFFSGNEIVG

SEQ ID NO: 19549 - protein, 449 aa, Oryza sativa (japonica cultivar-group)
MALRMSIAAMSVLAVAAVLVVAGTAAAAAASCPATPPDAGATLQVSHAFGPCSPLGAESAAPSWAGFLADQAARDASRLLYLDSLAVKGRAYAPIASGRQLLQTPTYVVRARLGTPAQQLLLAVDTSNDAAWIPCSGCAGCPTSSPFNPAASASYRPVPCGSPQCVLAPNPSCSPNAKSCGFSLSYADSSLQAALSQDTLAVAGDVVKAYTFGCLQRATGTAAPPQGLLGLGRGPLSFLSQTKDMYGATFSYCLPSFKSLNFSGTLRLGRNGQPRRIKTTPLLANPHRSSLYYVNMTGIRVGKKVVSIPASALAFDPATGAGTVLDSGTMFTRLVAPVYLALRDEVRRRVGAGAAAVSSLGGFDTCYNTTVAWPPVTLLFDGMQVTLPEENVVIHTTYGTTSCLAMAAAPDGVNTVLNVIASMQQQNHRVLFDVPNGRVGFARESCTAA

SEQ ID NO: 19550 - protein, 1005 aa, Aspergillus nidulans FGSC A4
MFTFTPLLGAQSSASKASQSILELDGGVKILVDVGWDDTFDPLDLVELEKHVSTLSLILLTHATPSHIGAYVHCCKTFPLFTQIPVYATSPVIALGRTLLQDVYESAPLAATFLPKASISEPGASTSAASAASVTEADGSADATSAGRILLQPPTTEEIARYFALIQPLKYSQPHQPIPSPFSPPLNGLTLTAYNAGHTVGGTIWHIQHGMESIVYAVDWNQARESVVAGAAWFGGSGASGTEVIEQLRKPTALICSTRGGDKFALPGGRKKRDEILLDMIRSTLVKGGTVLIPTDTSARVLELAYALEHAWRDAARDTQDDVLKRGGLYLAGRKVNTTMRLARSMLEWMDESIVREFEAAEAADTAGQNNDGQRSDQRQGKTDNKGLGPFTFKHLKTVERKKKLEQLLNDPTPKVILASDSSLDWGFAKESLRLLAGGENNLLLLTDPLHYSKFSDKHTDSHRRTLGSMIWQWYEERQDGVALEKGSDGEMLEQVHSGGRELSWTDIQRAPLEAGEQRLYQQYLATKRQFQDTAQARGQENLDTAADALDDRSSTSSEESDSEQQGRVLNFSTSLAHSNRNKLGLSDEDLGVNVLLRRKNVYDYDVRGKKGRERMFPYVAPRKKGDEYGEIIRPEEYLRAEEREEIDMQQRRTESQLKLGQKRRWDETQSAGGAARKQGVDSTERKDTDMLDNLSMTDIGDDTDTAAAPGEEDDQAFEGPAKAIYEKATLTINARLAFVDFTGLHDKRSLEMLIPLIQPRKLILVGGMKEETMALATECQKLLGVKTGADAPSPTAAVIFTPTNGEIIDASVDTSAWTVKLSNNLVRRLKWQHVRTLGVVTLTGQLKAPEPVSTDEDAINSPNKKQKLVEETSTPEQPTPTFQPQPTEPQQTTDKPDRYPVLDILPPNMASGTRSMTRPLHVGDLRLADLRKIMQNAGHKAEFRGEGTLLIDGFVAVRKSGTGKIEIEAAAYQAGPSAGFAQGAGSFLAVKQKIYEGLAVVAGG

SEQ ID NO: 19551 - protein, 292 aa, Triticum aestivum
  misc_feature (207)..(207): Xaa can be any naturally occurring amino acid
  misc_feature (268)..(268): Xaa can be any naturally occurring amino acid
  unsure (1)..(292): unsure at all Xaa locations
HYRTSLYKKAGWYRSGIPGISSTHASAIKLTKGQEITVSTDYDIKGDTNTISMSYKKLPQDVKPGHVILCADGTISLSVLSCDPAATVRCRCENTAMLGERKNCNLPGIVVDLPTLTEKDKEDILGWGVPNDIDMIALSFVRKGSDLVTVRQLLGQHAKRIKLMSKVENQEGIVNFDDILRETDAFMVARGDLGMEIPVEKIFLAQXMMIYKCNLAGKPVVTATQMLESMIKSPRPTRAEATDVANAVLDGTDCVMLSGESAAGAYPXVAVKIMPRICLEAESSLDNDAVFK

SEQ ID NO: 19552 - protein, 558 aa, Aspergillus oryzae
MAETTGPPHSDESIIGKKEALDLGKVESCSAGQYIERAGVKRNIKSRHAQMMAIGGAIGTGFFVGAGQALAIGGPGFLLLAYGLMSLLVYGVFTAVIEMSTYLPIPGSSIAYYCSRYVSPSLGYALGWLYFYSFGIIVAYEITAASLVINYWPNNVHIALWVTVLLVVIVGLNLCPVGVYAEAEFWFAGIKVIMIIGMIILSLIIMLGGAPTHDRLGFRYWNDPGATNAYIVPGSGGRFTSFLYVWVWSGFSFFFGPELMVFTGGEMRSPRKNLPKASRRYFGRLVVFYILGTLSMGVTCPSNAKGLTSNTGDANASPWVIAIRNAGITALPSIINACILTSAWSAGNAYLYMSSRALYSLAVAGSAPKIFARCTNYGLPIYAVLGSSCFTLLAYLNAGSQAGEVFNWFVCLTNTSGYTSWLTCCLIFLRFRKACNAQGIVMPYRSNIQPLAAWICLFVFAALLLCNGFTVFFPGRFSASEFLTAYLGIPLFLAIYFGHRLTVGRKDPWVYRPEDVDLRSGVEEVDAETETWARLEAMKRERNVRPNVVWSKISLIWS

SEQ ID NO: 19553 - protein, 563 aa, Yersinia pestis biovar Medievalis str. 91001
MHHSTPLITTIVGGLVLAFLFGTLAHRLRISPLVGYLAAGVLAGPFTPGFVADTSLAPELAEIGVILLMFGVGLHFSLKDLLAVKSIAIPGAIAQIAVATLLGMGLSHFLGWDLITGLVFGLCLSTASTVVLLRALEERQLIDSQRGQIAIGWLIVEDLAMVLTLVLLPAFAGVMGNETTNLNQLFTELAITIGKVIAFITLMIVVGRRLVPWILAKTASTGSRELFTLAVLVLALGIAYGAVELFDVSFALGAFFAGMVLNESELSHRAAQDTLPLRDAFAVLFFVSVGMLFDPMILVNEPLAVIASLAIIIFGKSAIAFALVRLFGHSKRTALTISVSLAQIGEFAFILAGLGISLGLLSGHGRNLVLASAILSIMLNPLLFTLLDRYLAKTETMEDLILEEAVEEEKQIPVDLCNHVLLVGYGRVGSLLGAKLHAEGIPLVVIENSRPRVEALREQGINAVFGNAANADVMALGRLDCARWLLLTIPNGYEAGEIVASARIKRPDLEIIARAHYDDEVVYISDRGANQVVMGEREIANSMLNMLKIETLTEEDKMPVCPI

SEQ ID NO: 19554 - protein, 332 aa, Chromobacterium violaceum ATCC 12472
MAIKVGINGFGRIGRMVFRAIAKDFPELEVVGINDLLDPEYLAYMLKYDSVHGRFQGDVKVEGGSLVVNGKTIRLTAEKDPANLKWNEVNAEIVIDCTGFFLTKEGCQKHIDAGAKKVVQSAPSKDDTPMFVYGVNHDKYAGETIVSAASCTTNCLAPVAKVLHDNWGIKRGLMSTVHAATATQKTVDGPSSKDWRGGRGILENIIPSSTGAAKAVGKVIPELNKKLTGMAFRVPTSDVSVVDLTVELEKEADYADICKAMKAASEGELKGVLGYTDEKVVSTDFVGNTAPSTFDADAGIALDKTFIKVVAWYDNEYGYTCNMLRFVKHVAG

SEQ ID NO: 19555 - protein, 336 aa, Streptomyces venezuelae
MAMRDSIPRRADRDTLRRELGQNFLQDDRAVRNLVTHVEGDGRNVLEIGPGKGAITEELVRSFDTVTVVEMDPHWAAHVRRKFEGERVTVFQGDFLDFRIPRDIDTVVGNVPFGITTQILRSLLESTNWQSAALIVQWEVARKRAGRSGGSLLTTSWAPWYEFAVHDRVRASSFRPMPRVDGGVLTIRRRPQPLLPESASRAFQNFAEAVFTGPGRGLAEILRRHIPKRTYRSLADRHGIPDGGLPKDLTLTQWIALFQASQPSYAPGAPGTRMPGQGGGAGGRDYDSETSRAAVPGSRRYGPTRGGEPCAPRAQVRQTKGRQGARGSSYGRRTGR

SEQ ID NO: 19556 - protein, 263 aa, Anaplasma phagocytophilum HZ
MKITILGCGSSVGVPSVGCECGVCASEHPHNKRTRTSALIEKGSTRLLIDASPDLRIQALRQNFYTMDAVLFTHCHADHTTGISELQAFTPKVGYHIPVYSDFGTLALITASNAYLFIPSTPGAPWKKCHYLTVNPVRHNVEFNIGEFSIMAIKQSHGEVNSNGFIFDNSVAYCTDVKSFPEASWERLRNKHMIIFGCLRYQAVGAHAHVDLCIEWIRELKPHIAVFTHMSHDIDYEQLLDYLHSKLPGQKVVVAHDGLELEL

SEQ ID NO: 19557 - protein, 107 aa, Ralstonia metallidurans CH34
MQVITAPELAQWLADAGRAKPVLLDVREDIEIRTAAMPDITHIPMGQIPGRLNELDEDAEIVCICHHGARSMQVANFLERQGYAKVYNLTGGIHAWSTQVDPSVPQY

SEQ ID NO: 19558 - protein, 235 aa, Aspergillus oryzae
MPADTDPSLQFDSIEDTIKAFKNGEFIIVLDSQDRENEGDLIIAADSITPAQMAFLVRFTSGLICAPVSPEIASRLSLPQMVIENADPKGTAYTISVDSSDPSVTTGISAQDRALACRTLASPTARAEDFRRPGHIIPLQARSGGVRERRGHTEAAVEFCRLTGKVQAGVIAELVEDGELVPGVPEIGGNNGMMRRDGCLKFGKKWGIKVCTIEDLVDYVEKTEGSSSVVTNGKQ

SEQ ID NO: 19559 - protein, 96 aa, Glycine max
  misc_feature (17)..(17): Xaa can be any naturally occurring amino acid
  unsure (1)..(96): unsure at all Xaa locations
DSSMISYPADTTDNPAXAEMTAPFTDLNALHVLPTIKTNNELTSIASNPGKLLCMQVCTPLVNKKFETLSYLPDLDDATFEDEPEYLLMNGWIPCL

SEQ ID NO: 19560 - protein, 92 aa, Shewanella sp. MR-7
MYKTAAAVHILVKHKEQAEDIIKQLNKGANFGALAKRYSSCPSAKKGGDLGEFKRGQMVPQFDKVAFSGELLVPHLVKTKFGWHVVKVLYRT

SEQ ID NO: 19561 - protein, 202 aa, Leuconostoc mesenteroides subsp. mesenteroides ATCC 8293
MADVEEIVKYMKTGGLIILVDDEDRENEGDLVGIGAKMSPENVNFMVTHARGLLCTPVGESITRRLGLTQMVANNTESNGTRFTFSVDAETVHGVTTGVSAFDRSATIRVLADPSSTEKDFVHSGHTFPLKALDGGFAVRNGHTEAAVDLAKLANEEPVGAICEILNEDGTMARLPQLLTMSKRFNLPLLSIKELTNYMEKI

SEQ ID NO: 19562 - protein, 478 aa, Oryza sativa
MAGAAAASAAAAAVASGISARPVAPRPSPSRARAPRSVVRAAISVEKGEKAYTVEKSEEIFNAAKELMPGGVNSPVRAFKSVGGQPIVFDSVKGSRMWDVDGNEYIDYVGSWGPAIIGHADDTVNAALIETLKKGTSFGAPCVLENVLAEMVISAVPSIEMVRFVNSGTEACMGALRLVRAFTGREKILKFEGCYHGHADSFLVKAGSGVATLGLPDSPGVPKGATSETLTAPYNDVEAVKKLFEENKGQIAAVFLEPVVGNAGFIPPQPGFLNALRDLTKQDGALLVFDEVMTGFRLAYGGAQEYFGITPDVSTLGKIIGGGLPVGAYGGRKDIMEMVAPAGPMYQAGTLSGNPLAMTAGIHTLKRLMEPGTYDYLDKITGDLVRGVLDAGAKTGHEMCGGHIRGMFGFFFTAGPVHNFGDAKKSDTAKFGRFYRGMLEEGVYLAPSQFEAGFTSLAHTSQDIEKTVEAAAKVLRRI

SEQ ID NO: 19563 - protein, 55 aa, Triticum aestivum
APPVSMAEKSISDALKCGKCAQKKVSYSQAQTRSADEPMTTFCECTVCGNRWKFS

SEQ ID NO: 19564 - protein, 452 aa, Pseudomonas putida KT2440
MNAPFDQLSTWLKEHRITEVECVISDLTGIARGKIAPTAKFLHERGMRLPESVLLQTVTGDYVDDDIYYNLLDAADIDMVCRPDPTAVYQIPWAIEPTAIVIHDTFDKQGNPIELSPRNVLKKVLKLYADKGWQPIVAPEMEFYLTKRCEDPDLPLQVPLGRSGRAESGRQSFSIDAANEFDPLFEDVYDWCEIQGLDLDTLIHEDGPAQMEINFRHGDALDLADQITVFKRTMREAALKHNVAATFMAKPITDEPGSAMHLHQSVVDIATGKPIFANEDGSMSQLFLHHIGGLQKYIPKLLPMFAPNVNSFRRFLPDTSAPVNVEWGEENRTAGLRVPTSSPEAMRVENRLPGADANPYLAIAASLLCGYLGMVEQIDPSAPVQGRAYERRNLRLPITIEDALQHMEDCETVQQYLGKQFVQGYVAVKRAEHENYKRVISSWEREFLMLSV

SEQ ID NO: 19565 - protein, 588 aa, uncultured archaeon GZfos3D4
MVDVIRMNMAFHKGGETERAIFKWLRENKKGMTKNVAVLGDLPGPKIRLGGVGGAIKVSKGEHFDLYFRKRNEVSKSKRAGASVLVNDKPFEEVVKKINEYDGIGDYIGESIRNNKDVVISIADGSVILKAVGESEGVVECEVEKEGEIKDHKGVTIKRAELDAPSFEQRDKEALRFLLDEGGDFLGFVGVSFVKDAEDVLKVRKYIEDYFFEKLKKEIKGKSFEEIKNILTFEPASRAEEKGALRKEARLRAPAVIAKIETKQAWRNIDEIIDVADGIMVARGDLGLQVDPQEVPSIQKKIIKLCNLRGKPVITATEMLSSMENNPEPTRAESTDVFNAILDGTDAVMLSGETSSGKYPAHAVRMMVNIAEQAEEYFEQKGLSTDLRKSLDTRRFEEISSGSASLLNDKERRFESRIYEAAVKIPDTTGKEKEWYQWIEDFYSQKLLNRKRQRIMDSISESSCILSLSEEGDGEGENAAIVASTLTGRTARMISRFRPSIKAIIGVVHDIHTAKKLVLSSGVYPLNIGKEKNGEKYSNMDEMFEEALKLATEEGRVQRGDKVIFIGGTPLWTVEEANLIQIHAYSVK

SEQ ID NO: 19566 - protein, 390 aa, Leuconostoc mesenteroides subsp. mesenteroides ATCC 8293
MLAKRVDSLEASPTLAMGKKAKDMIADGIDVVNLSQGEPDFNTPDNIGRAARIAIKDHLTDSYTATNGLVELKNAVVAAAKRDYNVSLLTDQVVITTGAKLALYALMQILVDPGDLVITSAPFWVSYSEQVKLAGGSFKAIVSSDPQFKLTIDVLNKLEEKPKVVILNTPNNPSGAVYSKNELESIISWTKTNDVYLILDEIYGKLVYGDTVFHSGLSLESLVNSKMIIINGVSKAYAMTGWRIGWAIADVSITHAMTKILGHLTSNPTVVAQYAAIEALNGQQKSVETMRKSFESRLNFLYRDLSEIDNISIPFKPSGSFYIFFKIDSKFMKKNNFKNTNEISMALLSEEKLAIPSGEGFGMPGYLRLSYAKSEAELIEAVKRLKHFFS

SEQ ID NO: 19567 - protein, 250 aa, Kluyveromyces lactis NRRL Y-1140
MSLSREDSVYLAKLAEQAERYEEMVENMKNVASSGQELSVEERNLLSVAYKNVIGARRASWRIVSSIEQKEEAKEKSEHQVQLIRTYRSKIESELTKICDDILSVLDTHLIPSATTGESKVFYYKMKGDYHRYLAEFSSGDVRESATQASLEAYKEASDIATTELPPTHPIRLGLALNFSVFYYEIQNSPDKACHLAKQAFDDAIAELDTLSEESYKDSTLIMQLLRDNLTLWTSDMSETGQEDQPAEGA

SEQ ID NO: 19568 - protein, 487 aa, Medicago truncatula
MRENISETWLVMIIVIMFTAIFAKVIQIKKRKEEKSIGRLPPGRRGWPLIGDSINWYNAVASSHPPQFVEEMVQRYGKIFSCSLFGKWAVVSSDPSFNRFVMQNEGKLFMSSYPKSFRDLVGKNGVITVQGEQQRKLHGIASNMMRLDKLKFHFMNDIQNVMIQTLSNFKNQQVILLQDVCRKVAINLMVNQLLGVSSESQVNEMAQLFSDFVDGCLSVPINIPGSSYHTAMKAREKIISKINKIIEVQRQNGPPKEGNNGVLGRLIEEDSLPDDAVADFIINLLFAGNETTTKTMLFAVYFLTQCPNAMEQLLDEQDSLRTKSAEESLTWQDYKAMPFTQCVIDETLRLGGIAIWLLREAKEDIQYQDFVIPKGCFVVPFLSAVHLDEKVYNEAKNFNPWRWMEPENEEKRNWRSSPFYAPFGGGARFCPGAELARLQIALFLHYFVTNYRWKQMKEDRMSFFPSARLVNGFEICLTKRHDNNQRN

SEQ ID NO: 19569 - protein, 507 aa, Musa acuminata
MSSGDSLNAELSEKTPVLGLRLWVVIGISVGVLIVFILCILSIWVTSRRKTRRTFDKLPVLQIPNVSKEITVDRVGTHSLAQSLQEHEGPFFSSYDKFSEKDSGKKLAHLTMSKSSDADNMSQCSSVHQNDRVGSSYSGDEGSSGHARKPYSPYSRVSASPLIGLPEFSHLGWGHWFTLRDLENATNRFSKENILGEGGYGVVYRGRLVNGTEVAVKRLLNNLGQAEKEFRVEVEAIGHVRHKNLVRLLGYCIEGTHRMLVYEYVNNGNLEQWLHGALHQHGVLSWENRMKVILGTSKALAYLHEAIEPKVVHRDIKSSNILIDEEYNGKVSDFGLAKLLGSGKSHVTTRVMGTFGYVAPEYANTGLLNEKSDVYSFGVLLLETITGRDPVDHGRPSNEVNLVEWLKLMVGNRRTEEVVDPNLDLKPPTRALKRALLVALKCLDPDSDKRPNMGQVVRMLEADEDRKSRRNRAASMEIESLKESNGSSDLENKVAGSDNWSCERFHA

SEQ ID NO: 19570 - protein, 465 aa, Aspergillus nidulans FGSC A4
MDPDSDNWTTAPKADHLCVLVHGLWGNPSHMGSIASALRKRYDEKQLHILVAECNTGNLTYDGIEVCGERLAHEIEATLSKLEADGHKMRKLSVVGYSLGGLISRYAIGLLYARGWLDDDKLEPVNFTTFASPHLGARAPVRGVQNLLFNGLGSRTISTSGKQMFLADTFQDTGKPLLSALADPNSIFIEGLKRFKNRCVYGNVVNDRTTAFYTTIFASEDHFRDLENKTIKYVKGYEPVVIDPDVYTLPASEDKKRPPFPLRAWQSIRTFFSKLPFWLFFCLILSIAIPVFLVYSVRETFRSRERIREHEEGPGKSFRSYRMPLGLRRIQTAMDEVFENAAARQDPDYISPNVPTTDLESQTASRNDKTGTAEDSPAAASSGNSTDDANKVKKVRCGEKRPTIALTPDQFSMIKSLNAVGFRKYPVYIHNHEHTHAAIVVRMDDPGYAEGHTVIKHWLDQEFDL

SEQ ID NO: 19571 - protein, 223 aa, Aspergillus oryzae
MWSWFGGSAAQKRKDAPKDAILKLREQLDMLQKREKHLENLMEEQDAVARKNVTTNKNAAKSALRRKKVHEKNLEQTTAQIIQLEQQIYSIEAANINQETLNAMKQAGAAMTQIHGNLTIDKVDETMDQLREQHQLSEEIAQAITNTQIGDQADETELDAELEGLEQEAMDERMLHTGTVPVADQLNRLPAAANGEPKGKSKVQEEEDEEAELEKLRAEMAMG

SEQ ID NO: 19572 - protein, 253 aa, Zea mays
MATSSAMSLQSISKTSLGNLSHNHHFHRSSFLGSSRSFQNLGISSNGPDFSSQSRSTSKNLSPTRAFFWNWGKSENARPSKVQELNVYELNEGDRNSPAVLKLGKKPELCLGDLVPFTNKLYTGDLKKRVGITAGLCVLIQHVPEKNGDRFEATYSFYLGDYGHLSVQGPYLTYEDTFLAVTGGSGIFEGAYGQVKLRQLVYPTKLFYTFYLKGIADLPLELTGTAVSPSKDVKPAPEAKATEPGATIKNFTN

SEQ ID NO: 19573 - protein, 689 aa, Zea mays
  misc_feature (253)..(253): Xaa can be any naturally occurring amino acid
  misc_feature (270)..(270): Xaa can be any naturally occurring amino acid
  unsure (1)..(689): unsure at all Xaa locations
ETQQTGATFTDGNPSTPTPSRPRPDPTRLQLQAKPPWRLRPRPPPRLTTARSSRPRAPTPPLRTPRSASRSARIPTPTPSARASPPRAAPAPAASTASLESSAAGKPTVLVAEKLGAAGLALLREFANVDCSYGLSPEDLRAKISLCDALIVRSGTKVGRDVFEASGGRLRVVGRAGVGIDNVDLAAATEHGCLVVNAPTANTGAAAEHGIGLITGMARKNAKADPLLKHETITYNILIEKGMFRIYLSLIRXSGDDDFTVTINPTYFSXKGKWQRNKYVGVSLVGKTLAILGFGKVGSEVARRAKGLGMHVIAHDPYASADRARAIGVELVSMEEAMTTADFISLHMPLTPATDKMLNDEAFAKMKKGVRIINVARGGVIDEEALVRALDSGVVAQAALDVFTKEPPAADNKLVLHGNVTVTPHLGASTVEAQEGVAIEIAEAVIGALKGELAASAVNAPMVPAEVLSELAPFVVLAEKLGRLAVQLVAGGGGIKSVKVTYASARAPDDLDTRLLRAMITKGLIEPISSVFVNLVNADFTAKQRGVRITEERILLDGSPETPIDYIQVQIANVESKFPSAISETGEITVEGRVKDGVPHLTKVGAFQVDVSLEGSLILCRQVDQPGMIGSVGSVLGEENVNVSFMSVGRIAPRKHAVMAIGVDEEPSKGTLTKIGEIPAIEEFVFLKL

SEQ ID NO: 19574 - protein, 476 aa, Oryza sativa
  misc_feature (388)..(388): Xaa can be any naturally occurring amino acid
  misc_feature (448)..(448): Xaa can be any naturally occurring amino acid
  unsure (1)..(476): unsure at all Xaa locations
MKNMKFLTDKRPPSLVVAEALQLLVVIVVAAWDREPHLSLPCSAPPDPPLSSSLPFLLPWKRSQGASRRRPSPRLHNHRPAVGSAQVGSAPDGSAVSLLHLLLRRLRRFHDPRRPLALPPSSPLARARRWDPSGSKDCKIVRGIIDAVAKIIGTSELQISLCKEMVEWTRAEKRTFLRQRVEARLAALLLENQEYTDALTLLTDLIKEVRRLDDKLLLVDIDLLESKLHFSLRNLPKAKASLTAARTAANAIYVPPAQQGTIDIQSGILHAEEKDYKTAYSYFFEAFEAFSALEDPKAIFSLKYMLLCKIMVNQADDVAGIISSKAGLKYLGPDVDAMKAVADAYSKRSLKYFETALRDYKSHLEEDPIVHRHLSSLYDTLLGQNLCXRLIDPYARVEIAHIAEMIELPVDHVEKKLSQMILDKKFAGTLDQGAGCLIIFEDPKTEAXIFPATLETISNVGKVVDSLYMRSAKIMA

SEQ ID NO: 19575 - protein, 442 aa, Thermotoga neapolitana
MIGYQIYVRSFRDGNFDGVGDFKGLKGAISYLKELGVDFVWLMPVFSSISFHGYDVVDFYSFKAEYGDEKDFREMIEAFHDNGIKVVLDLPIHHTGFLHTWFQKALKGDPHYRDYYVWASEKTDLDERREWDNERIWHPLEDGRFYRGLFGPLSPDLNYDNPQVFEEMKKVVYHLLEMGVDGFRFDAAKHMRDTLEQNVRFWRYFLSDIEGIFLAEIWAESKVVDEHGRIFGYMLNFDTSHCIKEAVWKENFKVLIESIERALVGKDYLPVNFTSNHDMSRLASFEGGLSEEKVKLSLSILFTLPGVPLIFYGDELGMKGIYRKPNTEVVLDPFPWSENISLEGQTFWKWPAYNSPFSGVSVEYQKKKRDSILLHIMKWTGFRKENHWLDRANIEFLCKEEKLLHVYRLVDEGRSLKVIHNLSNGEMVFEGVRVQPYSTEVI

SEQ ID NO: 19576 - protein, 268 aa, Synechococcus elongatus PCC 6301
MPITPRHLRQWKQQGRPIVALTAWDFAIASILDEAGIDLVLVGDSLAMVALGHPTTLPLSLEDMIHHVQAVQRGCRNALIVSDLPFLSYQTSPEDAILAAGQLLKVTEAQAVKLEGGYPRLLETVQRLVEVGIPVMGHVGLTPQSVRQLGYRQQGQTPEAQQQILDQALALEAAGAFAIVLEHIPDRLAAMITAKLSIPTIGIGAGPNCDGQILVTADLLGLTPSQPPFAPAYLNLRQAIGSAVQRYAREVRDRQFLQSQPAEQEPLS

SEQ ID NO: 19577 - protein, 758 aa, Aspergillus oryzae
MANARLGVVVSGTFIAALFLLLLFSVVSDSNQPPVVDSRYKWADRNTEFASDDSVFLLGAGRADITGPVVEIGFGGYASLDQIGTGLRQRIYSRAFIVANPNRPKDTFIYLIIDSLTGDTAVRHGVLEGLASLGSEFADYGEHNVAFTGTHSHSGPGAWMNYLLPQIPNKGFDKQSYQAIVDGVLLSIKRAHQSIAPGRLSFGSIDLENANINRSPYSYDHNPEEEKARYSDSVDKTMTLLRFDRATDNKTTAVLTFFPVHGTSMYNNNTLVTGDNKGVAAWLFERSVTADQKFADDFVAGFSQSNVGDTSPNVLGAWCEDGSGQKCRYEDSTCGGTMENCRGRGPFFREKDNGAKSCFEIGKLQYEAARKLYTQLDSNPTRILKSSDVNAFHIYQDLSDYTFISPFNASILKTCSAALGFSFAAGTTDGPGMFDFTQNSSGPAEKNPLWYAARAFIHQPSKEQKACQAPKEVLLDVGAVTQPYAWTPNIVDIQVLRVGQLFIIISTSEATTMSGRRWKEAIAKSAKDVLSVANPLVVLGAPSNSYAHYVATEEEYHVQRYEGASTLYGPNTLAAYINLTLTYLPYLGDSSSLPALDSKVKPPINTDKSLSFIPGVLYDGSPIGKTFGDVISSVDNATYGPGDTVNATFVGANPRNNLRQESTFAAVERQKPGTDTWEVVRTDRDWNLVYTWKRTNTVLGHSEVTIQWQIEDDYYNVGNPSSLKDGTYRLHYYGDFKTVKGDIGGFEGISGSFKVSTT

SEQ ID NO: 19578 - protein, 589 aa, Lactobacillus johnsonii NCC 533
MKKTKIVSTLGPASNDVETITKLAEAGANVFRFNFSHGDHEEHRARMNMVREVEKKTGKLLGIALDTKGAEIRTTEQEGGKFTINTGDTIRISMDDTKKGNKDMIHVTYDGLYDDTHVGGHVLIDDGLVDLLIKDKDDAKRELVCEAQNTGVIGSKKGVNAPGVEIRLPGITEKDTNDIKFGLKEGINFIFASFVRKAQDVLDIRQLLEEAHCEYVKIFPKIESQEGIDNIDEILKVSDGLMVARGDMGVEIPFINVPFVQKELIKRCNALGKPVITATQMLDSMQENPRPTRAEVTDVANAVLDGTDATMLSGESANGLYPVKAVKAMAEIDMRTEKQLAKRNKLALQRFEEYKGSNVTEAIGESVVRTAEELGVKTIIAATESGYTARMISKYRPNADIIAMTFNDKIQHSLGVVWGVKPMLTEKPKSTEEMFEKAAELAKETGLAKDGDLVIIVAGVPLGETGTTNLMKLQLIGTQLVKGLGVGEQSVIGKAVVATSAEEANSKVQDGDILVAKTTDKDYLPAIKKASGMVVEASGLTSHAAVVGLSLGIPVIVGATDAVEKIKDGSKITVDARRGAVYQGEATNL

SEQ ID NO: 19579 - protein, 226 aa, Candida albicans SC5314
MWGYFFGGNSQQKKDLPKKAIVELREHIQTLNKKKNHLQQQMDDQDQLARKYVSSKQTTLAKSALKRKKGYESNLLKVENQIETLETQLISIEGANLNLETMKAMKQGAKAMKQIHGEYDVDKVEDTMDEIREQVELADEISEAISRPVGNEFVDEDELDEELKELEAEAKEQEQEHRVPAQKAKPQPVSREEELPQFPSVNKKAPVVEEDEDEEALKALQAEMGL

SEQ ID NO: 19580 - protein, 315 aa, Oryza sativa
MEESVGSRGGSGGGGLDAQIEQLMECRPLSETEVKTLCEKAKEILMEESNVQPVKSPVTICGDIHGQFHDLVELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIDNLDSVRSLDRVQEVPHEGPMCDLLWSDPDDRCGWGISPRGAGYTFGQDISEQFNHSNNLKLVARAHQLVMEGYNWAHEQKVVTIFSAPNYCYRCGNMASILEVDDCRNHTFIQFEPAPRRGEPDVTRRTPDYFL

SEQ ID NO: 19581 - protein, 324 aa, Cryptococcus neoformans var. neoformans JEC21
MGRAEAGSTKAIANAIKAKGLGRLRWYCQVCEKQCRDENGFQAHCRSEPHMRKIMLLGPKAGQAISDFSRQFQSEFLLLLRTRHLTNRVQANKVYNEYIQDKHHVHMNATRWVTLSGFIQTIGKEGLVKVDEDEKGIWIQWVDNRPETLSKQAAAMKVERSQMDSEERERKMLEEQIARARAQQADQPDLTVGLQKKEGEKIKLNLFGASEPKTEEGKEEESASASAETKPTIGFGKLSAPGTAKPLAVSTNPLKRPAPVNVFKSSKAAKTESGGSAINGDSNGAPKYKSEAERLMMEDQARKASRGQGQGQGYRGFGPSRGGR

SEQ ID NO: 19582 - protein, 148 aa, Saccharomyces cerevisiae
MNATWVDQRGAWIIHVVIIILLKLFYNLFPGVTTEWSWTLTNMTYVIGSYVMFHLIKGTPFDFNGGAYDNLTMWEQIDDETLYTPSRKFLISVPIALFLVSTHYAHYDLKLFSWNCFLTTFGAVVPKLPVTHRLRISIPGITGRAQIS

SEQ ID NO: 19583 - protein, 466 aa, Arabidopsis thaliana
  misc_feature (251)..(251): Xaa can be any naturally occurring amino acid
  unsure (1)..(466): unsure at all Xaa locations
MLIKETNLGSFNLGGIFQRLLYCVPLKKSIYFVDRIGNYTDGSVSKTLNSTSSVFPQATEKENNFCLLRKGQLQDVYEHVLVNNALLICKVVLPERRISKKTLEARDPRYVNLEDKSLKVNGSSQLVNNGTRYRLEPDGNGYNYASAMKGAKVVDHNKEAKGASNVLGKDHDKYLRNPCSVSDKYVVIELAEETLVDTVRIANFEHYSSNPKEFSLSGSLSFPSDMWTPAGSFAAANVKQIQSFRLPEPKXTDQIGKETEAQKKKDDVVKTINIIGDKKYEVKEKHNVLKVMMQKVKLIEMNLSLLEDSVKKMNDKQPEVSLEMKKTLVLVEKSKADIREITEWKGKMKLPMNLIFFEQEKELRDLELWKTLVASRVESLARGNSALRLDVEKIVKEQANLESKELGVLLISLFFVVLATIRLVSTRLWAFLGMSITDKARSLWPDSGWVMILLSSSIMIFIHLLS

SEQ ID NO: 19584 - protein, 731 aa, Ustilago maydis 521
MYSHRSIVPSAGSQGPPSGPPPPGPGGAGPSQAAAAAAAAAAAAAAQQAPHPGGPVAGGPGGPAPTGPPGAAPGPPGAAPPAGAPHTGSARLADLLDFVRHEFDLLGNDTAQFKAQRDEMEHRVTSQVSEVNMMQTHFYELEKRHTQIIQQYEEEVKRLRSILDSRGLSSEHGAASATGPMSGPPHLPASATSGPLPIASAGGPPPPGGPGGAGSAAMFGPNGNGALGGPGSEYGRGPNGFDREREPPRGPTPGGKDSKRMRVEGPASHYSGPPSPGPERERDWIKKEERGDRGPPPRADEKWDRDQRVGGGAHLGPGPVQSPHGAPPLPPSNLYNRDMHRDARDRDSRPSEVASADSPGAAAAAAGNVTLASLSDMDPDEIPKELKKEGPDWLAIFNPKVKRTLDVNLVHTFLHESVVCCVRFSADGKYLATGCNKSAQIFDTKTGAKTCVLTDQSANSKGDLYIRSVCFSPDGKCLATGAEDRQIRIWDIGKKKVKHLFSGHKQEIYSLDYSKDGRIIASGSGDKTVRIWDVENGQLLHTLYTSPGLEHGPSEAGVTSVSISSDNRLVAAGALDTLVRVWDAQTGKQLERLKSHKDSIYSVSFAPDGKSLVSGSLDKTLKLWDLTGTAKAVQENRAEEKGGHANCATTFVGHKDYVLSVSCSPDGQWVASGSKDRGVQFWDPKTAQAQFVLQGHKNSVIAINLSPAGGLLATGSGDFNARIWSYDRISN

SEQ ID NO: 19585 - protein, 171 aa, Arabidopsis thaliana
  misc_feature (16)..(16): Xaa can be any naturally occurring amino acid
  misc_feature (29)..(29): Xaa can be any naturally occurring amino acid
  misc_feature (54)..(54): Xaa can be any naturally occurring amino acid
  misc_feature (69)..(69): Xaa can be any naturally occurring amino acid
  misc_feature (78)..(78): Xaa can be any naturally occurring amino acid
  misc_feature (84)..(84): Xaa can be any naturally occurring amino acid
  misc_feature (153)..(153): Xaa can be any naturally occurring amino acid
  unsure (1)..(171): unsure at all Xaa locations
LLKASPVLDKYEWVKXKSVLFRQTSSRSXVLRNRATSLTVRAVFSYADQLDKTXKLLHRPRHGILALDXSNATREKRXHSIGLXNTDANRQALQTLLDSAPRLGQYDSSAILFEETLLQSTTECKKIVDILGEHNIVPDIKAYKGLGPLVGSXNEPWCQRLNGLSSLTAAY

SEQ ID NO: 19586 - protein, 220 aa, Zea mays
  misc_feature (47)..(47): Xaa can be any naturally occurring amino acid
  misc_feature (73)..(73): Xaa can be any naturally occurring amino acid
  misc_feature (85)..(85): Xaa can be any naturally occurring amino acid
  misc_feature (97)..(97): Xaa can be any naturally occurring amino acid
  misc_feature (111)..(111): Xaa can be any naturally occurring amino acid
  misc_feature (157)..(157): Xaa can be any naturally occurring amino acid
  misc_feature (188)..(188): Xaa can be any naturally occurring amino acid
  misc_feature (206)..(206): Xaa can be any naturally occurring amino acid
  unsure (1)..(220): unsure at all Xaa locations
FNIPRRSPSAAIYRPSVQSTINSSILLSLHHDELIYNAAYIGTPSKXYLAAEEPTAPIGNRLSTLTCPQTTSXRLPLRDLQFCSXGALQDINGVLLXSMETLNQKTPDGKXSVEVLTDLHILPVVPDNMGTIDGVDNDKNTTNQGHDDLRIRHYMYXRSSIAHFAKRRGVLKIGATESSQLDIYLRAXALARYAIISHENGLSPIXDPDIPVDGPADIDH

SEQ ID NO: 19587 - protein, 407 aa, Zea mays
  misc_feature (135)..(135): Xaa can be any naturally occurring amino acid
  misc_feature (292)..(292): Xaa can be any naturally occurring amino acid
  misc_feature (342)..(342): Xaa can be any naturally occurring amino acid
  unsure (1)..(407): unsure at all Xaa locations
MRRVGTGVRMLCGAALSVLLLLAGGAAASHSRSSCPATPPDAGNTLQVSHAFGPCSPLGPGTAAPSWAGFLADQASRDASRLLYLDSLAVRGRARAYAPIASGRQLLQTPTYVVRASLGTPPQQLLLAVDTSNDXSWIPCAGCAGCPTSSAAPFDPASSASYRTVPCGSPLCAQAPNAACPPGGKACGFSLTYADSSLQAALSQDSLAVAGNAVKAYTFGCLQRATGTAAPPQGLLGLGRGPLSFLSQTKDMYEATFSYCLPSFKSLNFSGTLRLGRNGQPQRIKTTPLLAXNPHRSSLYYVNMTGIRVGRKVVPIPAFDPATGAGTVLDSGTMFTRLVAPXVTLPEENVVIHSTYGTISCLAMAAAPDGVNTVLNVIASMQQQNHRVLFDVPNGRVGFARERCTAA

SEQ ID NO: 19588 - protein, 457 aa, Geobacillus kaustophilus HTA426
MTKQQAPVAKNEYYDVTFTDLTHDGLGVAKVDGFPLFVKHALPGERAKVKAIKVKKGYGYGRLVELYEPSPDRVEPPCPVYRQCGGCQLQHLSYEGQLKAKEKQVKEVLARIGKLDGVTVHPVIGMKNPWRYRNKAQVPVGEREGGLVAGFYKERSHEIIDMDACLIQQEKNDDVVQAVKRIVERYGIPSYDELAHRGVLRHIVARYGAATGEVMVVLVTRTNHLPHEQEIVRSIVREIPDVKSIVQNVNPERTNVIFGAKTRVLWGSEFITDRIGGIQFAISARSFYQVNPEQTKVLYDKALEYAELTGRETVIDAYCGIGTISLFLARKAKHVYGVEIVPEAIEDAKRNAELNGIQNVTFEVGAAEDVIPRWYEEGVRADCLVVDPPRKGCDAALLETIIAMKPPRVVYVSCNPATLARDLRILEDGGYETIEVQPVDMFPHTAHVECVAKIRLR

SEQ ID NO: 19589 - protein, 481 aa, Penicillium janthinellum
STKNYRFLNEKTKANLVHHLPDVPYDIGEMYSGLMPIDMHNESRALFYIFQPTIGEPVDEVTIWMNGGPGCSSMESFLQETGRFLWQPGTYAPVENPYSWVVLTNVLWVDQPVGTGYSIGTPTATSQEETAQDFVKFFKNFQKTYGIKNFKIYVTGESYAGRYVPYISAAMLDEKDKEYFDLQGALAYDPCIGQFDYVQEEIPVVPFVKENANLFNFNETFMAELEHLHKSCGYADFIDKYLTFPPPKEQPPLFFNYTSMANEDVFDMVYNEVFKINPCFDLYEVNLMCPLQWDVLAFPTSLVYQPAGATVYFDRADVKKALHAPNVTWAECSNNPVFVGGSSGPEQEGDTSANPIEHVLPQVIEATNRVLISNGDFDMVILTNGTLLAIQNMTWNGHLGFQKKPSAPIDIKIPDLQYKEVFAENGASSLDGAQGIMGVQHYERGLMKAQTYQSGHMQPQYQPRVAYRHLEWLLKRTDELQ

SEQ ID NO: 19590 - protein, 231 aa, Streptococcus pyogenes M1 GAS
MVKLVFARHGESEWNKANLFTGWADVDLSEKGTQQAIDAGKLIKEAGIEFDLAFTSVLTRAIKTTNLALENAGQLWVPTEKSWRLNERHYGALTGKNKAEAAEQFCDEQVHIWRRSYDVLPPAMAKDDEYSAHKDRRYADLDPALIPDAENLKVTLERAMPYWEEKIAPALLDGKNVFVGAHGNSIRALVKHIKGLSDDEIMDVEIPNFPPLVFELDEKLNIVKEYYLGGE

SEQ ID NO: 19591 - protein, 128 aa, Zea mays
MSWSAPDDILLSTSLAGFLDKKLIVLLRDGRKLLGTLCSFDQFANVVLQGACERVIVGGQYCDVPLGLYVIRGENVVLIGELDHEKDELPAHMTCVLEAEIRKAEKAEREARDLKGTMRKRMEFLDFD

SEQ ID NO: 19592 - protein, 464 aa, Leuconostoc mesenteroides subsp. mesenteroides ATCC 8293
MAKANRVYKTKAPVAKNQEIEATVIDITYQGMGVVKVDNFPIFVVDAIPGEIVRVSVTKVLKSYAFGRVTRRIQESENRVQNANKIAITTGIAPLANLKYEAQLAFKQHQIEELFKKVNVDVDVAPTIGMENPTGYRNKAQVPVQMINGKLETGFYRRGSHRLVPIEDFYIQDPKVDEAVRITRDILRELGVSAYEEETKKGVIRHIMARRGYYSHELMVVIITNTKKLPNSDLIAEKLSAKLPELKSVIHNINNHDTNVIMGQWNETIWGEDDIHDQLMGKDFVIGPNSFYQVNPQTTSTLYALAAEKANLKPTDVVVDAYSGIGTITLSVADKVKKIYGVDVVEGAIEDAEKNAKNNQITNAEFVLADAPEQMAKWADEGLKPNVVFVDPPRKGLTQELIDAVKAMNPEKFVYISCNPATLARDAVQILAAGFEIEGAVQPLDQFPQTTHVESITVFKKAEN

SEQ ID NO: 19593 - protein, 366 aa, Agrobacterium tumefaciens str. C58; identical to SEQ ID NO: 374

SEQ ID NO: 19594 - protein, 472 aa, Thermotoga neapolitana
MYPIPSWVYDSVVYQIFPDRFFIGKGKTVEDKKDLYLKRGGTIEKWGVPPRKLPGAQHVKVFYGGDLWGIAEKIDYLEELGVNAVYLTPIFLSDTNHKYDTIDYFKIDPQFGGKRAFVHLLKVLHSRNIKLILDGVFNHVGSQHPWFKKARKKDPEYVNRFFLYRDRHRSWFDVGSLPELNVEVEEVREYILKVVQHYLEVGVDGWRLDCGHDLGPLVNLWINMKVKEFSSEKYLVSEIWTYPAGWEMVDGLMNYNFRSLVLSYVNGETDSIGTELERAYRETKNIFGCWNMLDSHDTPRLATTVPVKDLRKLAIVLQFTYPGVPLVYYGTEIGLTGGEDPECRATMEWNREKWDMELFEFYKKMIRFRRTDPGLRFGEFILLKEKPLAFMRKAPHPLQDTIVVVNPEEEKNVVLSLPDGKIMNATPLFDIFTGEKFHVDGGVVKVPVGRRSFRILKPIDLRVGRYRLYKRV

SEQ ID NO: 19595 - protein, 384 aa, Bordetella bronchiseptica RB50
MPRLATRTNDFLTFQVVELFKEAQALQAAGRDIISLGIGEPDFTAPPQVVEALERAARAGLSGYSAPAGLSALREAIAAFYESEFGARVDPARIIVTAGASGALALACAALVNPGAQVLMPDPSYPANSNFVLAAGGQPRLIPSTAAKRFQLSAQDVRDHWNDATQGVLIASPSNPTGTSIAHDELAELLAAVRERQGFSIVDEIYLGLSYESQPRSALLLDDDIIVINSFSKYFHMTGWRLGWMIVPESMVAKVEKMAASLAICAPTLAQHAALACFTPDALKIFEHRREAFKQRRDYLLPEFERLGIPVPVRPDGAFYIYADIAALGTTSMAFSHRLLHEGGVAAVPGLDFGPAHGERTMRFSYATGLDRLQEAVARIEKLL

SEQ ID NO: 19596 - protein, 372 aa, Triticum turgidum subsp. durum
MGAEAEQQQQQLPLPFPQAGKADPPAVVGLQVSALIDHVARVDWSLLDRVPGDRGGSQQVSFEELDHILNEVNALILPSHDDPSPVRTMAGGSVANTVRGLSAGFGISTGIIGARGDDDQGILFVNNMSFSGVDLTRLRAKKGHTAQCACLVDASGNRTMRPCLSSAVKLQANEFTKEDFQGSKWLVVRYAQQNLAQIIEAIRVAKQEGLSVSLDLASFEMVRDYKSQLIALLETGNIDLCFANEDEAREIIGGGLTYDPEDALAFLSKHCKWAVVTLASKGCIAKHGKQVVQVPAIGESNAVDATGAGDLFASGFLYGLVKGLPLEECCKVGVCSGGSVVRALGGEVRPENWQWMYKQMHAGGLLLPELKN

SEQ ID NO: 19597 - protein, 558 aa, Salmonella enterica subsp. enterica serovar Typhi
MHHATPLITTIVGGLVLAFILGMIANKLRISPLVGYLLAGVLAGPFTPGFVADTKLAPELAELGVILLMFGVGLHFSLKDLMAVKSIAIPGAVAQIAVATLLGMALSAVLGWSLMTGIVFGLCLSTASTVVLLRALEERQLLDSQRGQIAIGWLIVEDLVMVLTLVLLPAVAGMVEKGDVGIASLAVDMGITIGKVVAFIAIMMLVGRRLVPWIMARSAATGSRELFTLSVLALALGIAFGAVELFDVSFALGAFFAGMVLNESELSHRAAHDTLPLRDAFAVLFFVSVGMLFDPLVLIQQPLAVLATLAIIVFGKSIAAFFLVRMFGHSPRTALTIAASLAQIGEFAFILAGLGMALNLLPQAGQNLVLAGAILSIMLNPVLFTLLEKYLAKTETLEEQTLEEAIEEEKQIPVDICNHALLVGFGRVGSLLGEKLLAAGIPLVVIETSRTRVDELRERGIRAVLGNAANEEIMNLAHLDCARWLLLTIPNGYEAGEIVASAREKSPDIEIIARAHYDDEVKYITERGANQVVMGEREIARAMLELLETPPAGEVVAS

SEQ ID NO: 19598 - protein, 830 aa, Candida glabrata CBS 138
MGEEHKPLLDGSGAEPTVEDSTATAILRRKKKDNTLIVDDATNDDNSVIAINSNTMDKLELFRGDSVLVKGKKRKDTVLIVLIDDELEDGACRINRVVRNNLRVRLGDLVSIHPCPDIKYASRISVLPIADTIEGITGNLFDVYLKPYFVEAYRPVRKGDHFVVRGGMRAVEFKVVDVEPEEYAVVAQDTIIHWEGEPINREDEENNMNEVGYDDIGGCRKQMAQIREMVELPLRHPQLFKAIGIKPPRGVLMYGPPGTGKTLMARAVANETGAFFFLINGPEVMSKMAGESESNLRKAFEEAEKNAPAIIFIDEIDSIAPKRDKTNGEVERRVVSQLLTLMDGMKARSNVVVIAATNRPNSIDPALRRFGRFDREVDIGIPDATGRLEVLRIHTKNMKLADDVDLETLAAETHGYVGADIASLCSEAAMQQIREKMDLIDLEEDEIDAEVLDSLGVTMDNFRFALGNSNPSALRETVVESVNVTWDDVGGLDEIKEELKETVEYPVLHPDQYTKFGLAPSKGVLFYGPPGTGKTLLAKAVATEVSANFISVKGPELLSMWYGESESNIRDIFDKARAAAPTVVFLDELDSIAKARGGSLGDAGGASDRVVNQLLTEMDGMNAKKNVFVIGATNRPDQIDPAILRPGRLDQLIYVPLPDEPARLSILKAQLRKTPLEPGLDLTAIAKATQGFSGADLSYIVQRAAKYAIKDSIEAHRESLAAAEAEVKTEGGDVDMTSEDVKKEPVETVDPVPYITREHFAEAMKTAKRSVSDAELRRYEAYSQQMKASRGQFSNFNFGDSNQGTTETGNDGNSGANFGSAGDDDDDLYS

SEQ ID NO: 19599 - protein, 417 aa, Brassica napus
MAATAATTSSSHLLLSSSRHVAASSQPQILFQRSLFSGGKRSAAGKNHHASGGVRCMAVAADASAEAKPAAARKKSGYELQTLTGWLLRQEQKGEIDTELTIVMSSIAMACKQIASLVQRAGISNLTGVQGAVNIQGEDQKKLDVVSNEVFSNCLRSSGRTGIIASEEEDVPVAVEESYSGNYIVVFDPLDGSSNIDAAVSTGSIFGIYSPNDECIVDDSDDISSLGSEEQRCIVNVCQPGNNLLAAGYCMYSSSVIFVLTLGKGVFSFTLDPMYGEFVLTQENIEIPKAGKIYSFNEGNYQMWDEKLKKYIDDLKDPGPSGKPYSARYIGSLVGDFHRTLLYGGIYGYPRDAKSKNGKLRLLYECAPMSFIVEQAGGKGSDGHQRVLDIQPTEIHQRVPLYIGSKEEVEKLEKYLA

SEQ ID NO: 19600 - protein, 101 aa, Vigna radiata
WLTGAPGCSSELALFYENGPFQLTKNLSLVWNDYGWDKASNIIFVDQPTGTGFSYTSDESDIRHDEEGVSNDLYDFLQAFFKEHPQFTKNDFYITGESYAG

SEQ ID NO: 19601 - protein, 145 aa, Brassica napus
MASCDTPDAFAWLQNLPPFSQWKRNSMSMCICSPNSSHPSLNFSITRSSQSPNTFTFSIVASFKIPISLFISKPLRIIGSNQTNLLSENIISTLLMSFVDTVLNYNVKRTTCSIQMQNIGSTSNLKDVFNLAFFTFVFLIYRYRR

SEQ ID NO: 19602 - protein, 469 aa, Mesorhizobium sp. BNC1
MTTAQDILKQIKDNDVKFVDLRFTDPKGKLQHVTMDVVAVDEDMFADGVMFDGSSIGGWKAINESDMVLMPDPETAHVDPFFAQSTMVVYCDILDPISGEAYNRDPRGIAKKAEAYLRAEGIGDTVFIGPEAEFFVFDDVKYKADPYNTGFKLDSSELPSNDDTDYETGNLGHRPRVKGGYFPVPPVDSLQDMRSEMLSVLTEMGVVVEKHHHEVAAAQHELGLKFDTLVRNADKMQIYKYVVHQVANAYGKTATFMPKPIYGDNGSGMHVHLSIWKDGKPTFAGNEYAGLSESCLYFIGGIIKHAKAINAFTNPTTNSYKRLVPGFEAPVLLAYSARNRSASCRIPFGTSPKSKRVEVRFPDPTANPYLCFSALLMAGLDGIKNKIHPGQAMDKDLYDLPPKELKKVPTVCGSLREALMSLDKDRGFLKAGGVFDDDQIDAYIELKMAEVLRFDMTPHPVEFDMYYSV

SEQ ID NO: 19603 - protein, 148 aa, Saccharomyces monacensis
MNATWVDQRGAWIIHVVVITLLKLFFNLFPGVTAEWSWTLTNMTYVVGSYVMFHLIKGTPFDFNGGAYDNLTMWEQIDDETLFTPSRKFLIIVPIALFLVSTHYAHYDLKMFSWNCFLTTFVAVVPKLPVTHRLRISIPGITGRAQIS

SEQ ID NO: 19604 - protein, 490 aa, Burkholderia vietnamiensis G4
MPLTLSRTELVRTANLVDGSWRAALDGRCFDVTNPATLDTIAYAPDSGAADARAATDAAARALPAWRATPARERAAILRAWHAAIVAHTDDLAKLMSLEQGKPLAEARGEVAYGASYVLWFAEEATRTYGDLIPQQQRGKQLSAVKVPIGVVAAITPWNFPLAMIARKIAPALAAGCTVVAKPAEDTPLTALALGFLAMEAGVPPGVLNLIAASRERGIDAVADWLADARVRKITFTGSTAVGKLLARESAATLKKLSLELGGNAPFIVFDDAQLDAAVDGLMAAKFRNGGQTCVSPNRVYVQAGVYDAFAAKLAARVAALKVAPATDPAAQIGPMINARAVDKIARHVGDALERGARVLTGGRRLSQLGPNYYAPTVLADATADMQLSCEETFGPVAALFRFDTEEQAVDAANDTPFGLAAYFYTQDVRRIARVSARLETGIVGINEGALASEAAPFGGVKESGYGREGSKYGLDDYLSIKYLCQGGLD

SEQ ID NO: 19605 - protein, 219 aa, Photobacterium sp. SKA34
MTQDEMKKAAGWAALEYVQKGTIVGVGTGSTVNHFIDALATRKEEIKGAVSSSVASTERLEQLGITVFDANEVASLDIYVDGADEINADYDMIKGGGAALTREKIVAAIAKKFICIVDDTKQVDVLGQFPLPVEVIPMGRSFIGRELVKLGGDPAYREGVVTDNGNMILDVYNMKITDPKTMEDKINALPGVVTVGLFAHRGADVLLVGSPDGVKKFEK

SEQ ID NO: 19606 - protein, 409 aa, Photobacterium sp. SKA34
MAKVSLNKDKIKILLLEGLHPSSLEVLQQAGYTNIEYHKGSLAGEELLEAVKDAHFIGIRSRTQLTPEVFAAARKLTAVGCFCIGTNQVDLDEAMRRGIPVFNAPFSNTRSVAELVLGELLLLLRGIPEKNAKAHRGEWIKSADNSFEARGKTLGIIGYGHIGTQLGILAENLGMRVCFYDIESKLTLGNATQVASLSELLNKSDVISLHVPETPETQNIMGAEEFARMKPGSIFINAARGTVVDIDALCSALESKHIAGAAIDVFPVEPKTNNDPFESPLLQFDNVILTPHIGGSTQEAQENIGIEVAGKLVKYSDNGSTLSAVGFPEVSLPEHRGCSRLLHIHENRPGVLNQITTIFASEGINIAAQFLQTGAEIGYVVIDVETERSKEALAKLKTIEGTIRARILH

SEQ ID NO: 19607 - protein, 846 aa, Ustilago maydis 521
MANHQAHERNSQPSPKPSHLPVDPASASTLPSELLTSAPECTSSVATPLQFPDLASSPPPPSNLSRQQQLHHQQQQLLGSCTRDSSSSLSSVPSSSASEPSPKQGETTRLSCKRSAPSQSYTASRRTRSSVDLAAAASASIARQPVLLSSRFGAPTSLDSSDTFPLRPLPSHLVSGHYNHAASLPSSPLARHQSRVHHQRTLDSLRFQGTFASVQAESHREQCLSRGSTLALIKPGSHLSPEVSEQTFPLQTLPTPSIASHRGVFREHSQLRHAFSLHPYPLFNQLHPAAHYRMDTQAPMTQSQAHTQAQAQAQHQMQMQMQMQMAQAQQAQAQAQQQAHILRRKNAQDVLVGQGFRGLKRGRPTDRSLPPSLKRQVPESAFYSDLQRIEKNLDWTVARKRAELTDGLSRPPKIKRTLRIFLSNTCANQPFQLAEKQKVKDSAPSVETADGAEVKVEGDKDAADSKEEDAVPSWTLRIEGRLLEPSFKSRANTALSAQASINRTGAHKFSNLIKTCVVELMRDPSLYPDGSNIVEWHRPVPSVAPASGMQAGGGAGGLGGTQGMEAPLVASAEPALDGFEIKRKGNVPTKVKIVLYPAYTPERYSLSPELGSLLDIREESRAGVISALWSYVKEKKLLDETDRKKVKCDSALRSLFNTDTINFHHMPEVVNRHLHPAQPIVIEYWVRTDKAEYKHSTAYDIELDLEDLAIRQKQHNVLAQFDTTNDATSREIAELDDKIAQAAATIRNRASARDFLAAFAKDPQGHLRTWIASQARDLDAILGNNPVPGAGGSVSSFTAEEMRRAETFKGAWVDEAVIVNEAQRLAEKLQELQSQAAQPNPGQAGM

SEQ ID NO: 19608 - protein, 553 aa, Oryza sativa
MASISPTSSSVAALRGHPVQFVKGGAVSKEAKGSISFSPVANSNNANVKFTGLRVAASLKRDGAFPGDGYSGNDNTVLPKSTSVRGQDYPTADSVLPTESIIVPEISNAGLKCVADMFSDEDKDTEQDLDSPTEGFSSISEAIKDIQQGKLVIVVDDESRENEGDLIMAASLVTPEAMAFVVRYGTGIVCVSMKEEDLERLNLPLMVATKENEEKLCTAFTVTVDAKEGTTTGVSAKDRAKTVMTLASPDSKPEDFNRPGHIFPLKYREGGVLKRAGHTEASVDLAMLAGLPPAAVLCEIVDEDGSMARLPKLRVFAERENLKIVSIADLIRYRRKRDRLVERSSVARLPLRWGNVRAYCYRSVIDGIEHIAMVKGEIGDGQGVLVRVHSECLTGDIFGSARCDCGDQLAMAMEMIEKAGRGVLVYLRGHEGRGIGLGHKLRAYNLQDDGRDTVEANEDLGLPVDSREYGIGAQILRDLGVRSMKLMTNNPAKYGGLKGYGLSIVGRVPLVTPITSENRRYLETKRTKMGHVYGLANGQASHQTGSNGAKGEH

SEQ ID NO: 19609 - protein, 222 aa, Zea mays
MSMFNRIFGKPKEQANSSALATLDKLNETLDMLEKKEKVLDKKAAAELERAKEFSKAKNKRAAIQSLKRKKLYEQQIEQLGNFQLRIHDQMIMLEAAKATTETVDALRTGAAAMKAMQKATNIDDVDKTMDEINEQTENMKQIQDALSTPLGASADFDEDELEAELEELEGAELESQLLEPVAALPVHPVHVPGNKQPARPAPQKATAEDDELAALQAEMAL

SEQ ID NO: 19610 - protein, 311 aa, Kluyveromyces lactis NRRL Y-1140
MDQQSVDVDDIIDRLLEVRGLKPGHQVDLEEHEIRYLCSKARSIFIKQPILLELEAPIKICGDIHGQYYDLLRLFEYGGFPPESNYLFLGDYVDRGKQSLETICLLLAYKIKYPENFFILRGNHECASINRIYGFYDECKRRYNIKLWKTFTDCFNCLPIAAIVDEKIFCMHGGLSPDLNTMEQIRRVMRPTDIPDVGLLCDLLWSDPDKDIVGWSENDRGVSFTFGPDVVSRFLQKQDMELICRAHQVVEDGYEFFSKRQLVTLFSAPNYCGEFDNAGAMMSVDESLLCSFQILKPASKLLERNVVRRKK

SEQ ID NO: 19611 - protein, 313 aa, Zea mays
MDAAAAAAAAASPTSKRIALVTGGNKGIGLETCRQLASRGVRVVLTARNEARGLEAVERVRCARGDAEVYFHQLDVTDPCSAARLADFVRDQFGRLDILINNAGISGVHRDPVLSAAVKDKVDGMDVNQRVEWMKENSKETYEEAVQCMKTNYYGAKLVTEALLPLLQLSSSGRIVNVSSGFGLLRNFNSEDLRKEFEDIDNLTESRLEELMDKFLEDFKANLVEAHGWPTGGSSAYKVVKAALNAYTRILAKKYPTLRINCLTPGYVKTDMSMHMGVLTLEEGARNPVKVALLPDDGPTGAYFDLNGEASFV

SEQ ID NO: 19612 - protein, 741 aa, Arabidopsis thaliana
MKFQEGVFLVVIFFLAYTQLVKGQHQPREDCKLKCGNVTIEYPFGISTGCYYPGDDNFNLTCVVEEKLLLFGIIQVTNISHSGHVSVLFERFSECYEQKNETNGTALGYQLGSSFSLSSNNKFTLVGCNALSLLSTFGKQNYSTGCLSLCNSQPEANGRCNGVGCCTTEDFSVPFDSDTFQFGSVRLRNQVNNSLDLFNTSVYQFNPCTYAFLVEDGKFNFDSSKDLKNLRNVTRFPVALDWSIGNQTCEQAGSTRICGKNSSCYNSTTRNGYICKCNEGYDGNPYRSEGCKDIDECISDTHNCSDPKTCRNRDGGFDCKCPSGYDLNSSMSCTRPEYKRTRIFLVIIIGVLVLLLAAICIQHATKQRKYTKLRRQFFEQNGGGMLIQRLSGAGLSNIDFKIFTEEGMKEATNGYDESRILGQGGQGTVYKGILPDNTIVAIKKARLADSRQVDQFIHEVLVLSQINHRNVVKILGCCLETEVPLLVYEFITNGTLFDHLHGSIFDSSLTWEHRLRIAIEVAGTLAYLHSSASIPIIHRDIKTANILLDENLTAKVADFGASKLIPMDKEQLTTMVQGTLGYLDPEYYTTGLLNEKSDVYSFGVVLMELLSGQKALCFERPQASKHLVSYFVSATEENRLHEIIDDQVLNEDNLKEIQEAARIAAECTRLMGEERPRMKEVAAKLEALRVEKTKHKWSDQYPEENEHLIGGHILSAQGETSSSIGYDSIKNVAILDIETGR

SEQ ID NO: 19613 - protein, 275 aa, Salmonella typhimurium LT2
MANPTIIRLQDGNVMPQLGLGVWKASNEEVIAAIHKALEVGYRSIDTATAYQNEEGVGKALKAASVAREELFITTKLWNDDQKRPREALQESLKKLQLDYLDLYLMHWPVPAIDHYVDAWKGMIALQKEGLVKSIGVCNFQIHHLQRLIDETGVTPVINQIELHPLMQQRQLHAWNATHKIQTESWSPLAQGGEGVFDQKVIRELADKYGKTPAQIVIRWHLDCGLVVIPKSVTPSRIAENFAVWDFRLDKDELGEIAKLDQGKRLGPDPDQFGG

SEQ ID NO: 19614 - protein, 182 aa, Arabidopsis thaliana
  misc_feature (35)..(35): Xaa can be any naturally occurring amino acid
  unsure (1)..(182): unsure at all Xaa locations
MASSMLSSAAVVTSPAQATMVAPFTGLKSSASFPXVTRKANNDITSITSNGGRVSCMKVWPPIGKKKFETLSYLPDLTDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTDA

SEQ ID NO: 19615 - protein, 504 aa, Kluyveromyces lactis NRRL Y-1140
MFRNSNTLRTLNLLRKMSSKIENDYLIQTKAFINGKWTETDDKFAVTNPSTGDTIREVTNCGVSDFNKAIEIAHDAFGTFRQTNVRERAQILDNIYNLMLENKQDLAKILTLENGKPYKDSLGEIVYSAMFFKWFAEEAPRIYGDIIPSAVSSDQKIFTIRQPLGVIGILTPWNFPSAMIARKLAPVIATGNTCVIKPAHETPLSALALGVIAEKAGLPAGVCNILPTNHTSEIGEYVCEHELVKKITFTGSTKIGQLLMGQSSKGKNIKKFSMELGGNAPYIVFKDADLDRALDGIIGCKFRQSGQTCICANRIFVHEDLYDEFSKRLVDKIDKTFKLGDGFQDGVTHGPLIHDKSIDKVASLVQDAKTKGADVLIGGSRASSLGPLFYQPTVLGNVTESMDIFYEEIFGPVAPLIKFKDVDEVIKRANDTDVGLAGYFYSQNISTIFDAAEKLNVGMVGVNTGEISEPAVPFGGVKNSGLGKEGSKYGIDDYTELKAIIVAP

SEQ ID NO: 19616 - protein, 310 aa, Aeropyrum pernix K1
MLEHLVQAVAVGHALVDLRLYVERIPGVDEEAVIKDETRSVGGSAANVAVVLRRLGVQSGIIGKIGLDDFGRIAVDNLMREGVDISGLRVSLRDRTGFSVVVRDKEGSITIYSFKGAAEKLEPGEIDADAIGRSKHVHVASLRPDTTLKTVEIAKKRSITVSWDPGRVLSKMGAERLANIISKVDIIFVNRNEAKNLTGYHDYRQAARHLKKLGPKIVVIKLGASGSYILYSDGEVFVPAIKPERVVDTTGAGDSYAAGFIAGLLRGYTIEKASLYATIVASIKVSRLGSNAAPSHEEVVEKARELGVEI

SEQ ID NO: 19617 - protein, 447 aa, Methanosarcina acetivorans C2A
MVQMKKCTTKEDVLEAVKERDVKFIRTQFTDTLGIIKSWAIPAEQLEEAFENGVMFDGSSIQGFTRIEESDMKLVLDPSTFRILPWRPATGAVARILGDVYLPDGKPFQGDPRYVLKTAISEAEKMGFSMNVGPELEFFLFKLDANGNPTTELTDQGGYFDFAPLDRAQDVRRDIDYALEHMGFQIEASHHEVAPSQHEIDFRFSDVLNTADNVVTFKYVVKSIAYHKGYYATFMPKPLFGENGSGMHSNQSLFKNGKNAFYDPDTPMQLSQDAMYYIGGLMSHIKEFTAITNPVINSYKRLVPGYEAPIYITWSSKNRSSLIRIPATRGEGTRVELRCPDPSCNPYLAFALMLRAGLDGIKSKIDPGEATNVNIFHLTEKERAERSIHSLPGDLKEAIDEMKGSQFVKEVLGEHVFSHYLCAKEMEWDEYKAIVHPWELEKYLPML

SEQ ID NO: 19618 - protein, 130 aa, Oryza sativa
  misc_feature (72)..(72): Xaa can be any naturally occurring amino acid
  misc_feature (105)..(105): Xaa can be any naturally occurring amino acid
  unsure (1)..(130): unsure at all Xaa locations
MSAYCGKYKDELIKNAAYIGTTGKAILADHEISATIGKRFASINVDIVEANRRSLRELLLNTPGALQHHKGXVILLEETLYQKTKDGKPSMDVLKEAGAHAGIQXDKDTVDVDRPTKETTTQGHDDLGMR

SEQ ID NO: 19619 - protein, 396 aa, Pseudomonas putida KT2440
MRYAKLTQRIAGDGAAAWDIHYRALALQAEDKDILLLSVGDPDFDTPAPIVEAAIDSLRAGHTHYADVRGKLALRQAIANRHRQRSGQAVSADQVTVLAGAQCALYCVAQCILDPGDEVIVAEPMYVTYEAVFGACGAKVVPVPVKPENGFRVCPRDVAERITPRTRALALNSPHNPSGASLPRATWEALAELCVAHDLWLISDEVYSELLYEGEHVSPGSLPGMAERTATLNSLSKSHAMTGWRMGWVVGSTALATHLENLALCMLYGLPDFVQDAAVVALEHPLPELDAMREAYRQRRDLVCEQLAGCPGLKALKPDGGMFVMLDIRETGVSAQAFADYLLDSQGVSVLAGEAFGPSAAGHIRLGLVLGNEALVDACQRIARCAGELMRGQTDA

SEQ ID NO: 19620 - protein, 571 aa, Anaplasma phagocytophilum HZ
MHHSSYLLDVIVLLAAAVVVVVLFWKLRISPVLGYFVAGAAIGTHGLQLVESSSIINSLAEFGVVFLLFLIGIELTFERLSAMRMHVFGFGTLQVIVTATLIWCVARGLGVDSESSVVIGGALALSSTAIVLQVLQEKGMQSSQVGRLSIAVLLLQDFAVVPLIVLLPLLAGESNSLVGSLFIAFLKAGVALALIFVTGRLLLRPLFGTIAAMKSNEVFIASTLLIVLGAAFVTENFNLSMALGAFVSGLLVAETEYRYDVEQVVLPFKKLLLGLFFMTVGMSIDTELLLSKLPVVAALSLSLMLLKSFIVCVLCRCFRFSLSAGLQAGLLLSQGGEFSFILFGLAAEKSVLSHDLAQVLMMATTVTMAFTPLLATLGNWISGFLTKNKVSYTSSALVLDTSDLDQHVIVVGFGRVGRLVAKVLMAEHVNYIASDIQPSVVTEGRKEGFPVYLGDLTKLEVLTAMGASRATAIAIAINNEVTAKKVIALVAKNFPDTIIAVRIPDLSNADMYKKLGAHYLIPETYEAGLQLGGIALSISGFSDNAILSLQNAFRMEDYQRPVKKESSDDVR

SEQ ID NO: 19621 - protein, 473 aa, Gluconobacter oxydans 621H
MSQKIVPVILSGGSGSRLWPVSRSSYPKQFWPLLSKHTLIQETALRGARAGLADPIVICNAEHRFIVAEQLRDVGVKNARIVLEPVGRNSAPAIAAAAFLVAETDPDAVLWIMAADAAITDEAALYSALEHAVAAAAQGRIVTFGMKPTRVETGYGYIESGAPLSSLEGVYEVSRFVEKPDAVTAEAFFRDGRYLWNSGMFVTQAGVFLSEIQTFEPAIHEHVGQAVRARRSDLDFDRLDDASFRQAPDISVDYAVAERTKRAAVVPGTFGWSDIGSWDALWELTSKDEAGNATFGDVFLDDARNCYVRSDGIVATVAGVEDLIVVVTQDAVMVSHRDRAQDVKHMVSRLKKAGRKEAVAHNRMYRPWGFYESLIQADRFQVKRIVVEPGQKLSLQKHFHRAEHWVVVGGTALVTRDADQIMVRENESIYLPLGCVHRLENPGRIPLTLIEVQSGPYLGEDDIVRIEDVYSRN

SEQ ID NO: 19622 - protein, 602 aa, Yersinia pestis biovar Medievalis str. 91001
MEGTGLLTAVLVFLFAAVVAVPIAQRLGIGAVLGYLIAGIAIGPWGLGFIRDVDEILHFSELGVVFLMFIIGLELNPAKLWQLRRSIFGVGAGQVVITAAVLGALLYFTQFAWQAAVIGGVGLAMSSTAMALQLMREKGMNRNEGGQLGFSVLLFQDMAVIPALALIPILAGNEGGANDWVKIGLKIAAFAGMLIGGRYLLRPLFRYIVASGVREVFTAAALLVVLGSALFMDALGLSMALGTFIAGILLAESEFQHELEIAIEPFKGLLLGLFFISVGMALDLGVLFTHLLDVLLGVLALVFIKSAILYGLARVFGLRRSVRLQFAGVLSQGGEFAFVLFSAAFSQRVLNAEQLALLLVVVTLSMMTTPLLMQVIDRILVRRYNAQEESDEKPFVEDNDPQVIIVGFGRFGQVIGRLLMANKMRITVLERDVSAVSMMRKYGYKVYYGDATELELLRAAGAEKAKAIVITCNEPEDTMALVHLCQQHFPNLHILARARGRVEAHELLQNGVKDFTRETFSSALELGRKTLLELGMHPHQAYRAQQHFRRLDMRMLRELMPQHHGDVAQISRIKEARRELEDIFQREMLHESRQLDGWDEYE

SEQ ID NO: 19623 - protein, 413 aa, Pseudomonas putida KT2440
MTAEGFLEGRRLQMARGVLLQCIMGGYPPAKFYGSDDGDLALVAEPSQVHRLPWSDDGRALAICDANELDGRPSALSTRGQLKAVIARYAALGLAPVVATELEFFVFAPNTDPQQPFLPPVGSDGRRELGHSAFSVSSNNGLRPFFKEVYHCMAALGLPRDTFMHEMGVSQFEINLLHGDPLLLADQTFLFKHLLKEVALKHGLTVVCMAKPLARTPGSSMHIHQSLVEAGSGRNVFSDEQGLPTETFHHFIGGLQACMADFTALFAPNVNSYQRLCHPYASPNNACWSEDNRAAGLRIPASAPVARRVENRLPGADANPYLAIAASLAAGLHGIEQRLQPSPAIQGEFEVPEHLSLPCTLHAALERLKRSTLARELFGSEFIEGYIASKTLELSDFFDEITPWERRVLAAQA

SEQ ID NO: 19624 - protein, 222 aa, Lactobacillus plantarum WCFS1
MTIKQAIVQQALTLIKPQMVVGFGGGSTVGELVKEAANHVNDITVVTPSPTTRQLATVLGYTVVDTAYCDRVDIAFDGCDQLDHHGNALKSGGGIHANEKIIASLADEYWLLTMQDRLVDQFDIKTPLVLEVLPAALSLVMRTVSDLGGQATIRTANNRDGFTLTDSGNLLIDCHFPTYAKLTDLNVELATLAGVVETSYFDHLVTNAWLGDATTNTVKALF

SEQ ID NO: 19625 - protein, 333 aa, Cryptococcus neoformans var. neoformans JEC21
MAPASHFTLNNGKKIPSIGLGTWQSEPGQVAKAVESALKSGYRHIDCAWAYGNEKEVGEGLKASGVPREEIHITSKLFELHHHPEHVELACKDTLKNLGVEYLDLYLLHWNINFQVDAPKGTVPTFDHAVKADNGKIKLDVALADNVMPTWREMEKLVEKGLVKSIGISNFNIHRTEKLLKEAKIKPVADQVELSIQCPQHELVAYLKSKDILPQGYSPLGGTGKSNLRENDVVQKIADKYKVQTANILLSWLVMRGINPVPKSVTPERIANNLKLVDLSQEDFKELEKLAESHPPKRVCDQSEDFEPKYDIFQENDPEFSDKAQFAKLGLKL

SEQ ID NO: 19626 - protein, 294 aa, Vigna radiata
EHPQFTKNDFYITGESYAGHYIPALASRVHQGNKAKEGIHINLKGFAIGNGLTNPEIQYQAYTDYALDRGLIQKADYNSINKLLPSCKQAIEDCGTEGGETCVTSLYVCNKIFNRIMNIAGDVNYYDIRKKCVGDLCYDFSEMEEFLNKKTVRDALGVGDLDFVSCSSTVYSAMMEDWMRNLEAGIPALLEDGIKVLVYAGEEDLICNWLGNSRWVQAMEWSGQKEFGASGAVPFLVDGAEAGTLKSHGPLAFLKVYEAGHMVPMDQPKAALTTLRSWMQGKLTMTKNGDKRLS

SEQ ID NO: 19627 - protein, 318 aa, Synechocystis sp. PCC 6803
MKPTVIITGASSGVGLYGRKALIDKGWHVIMACRNLDKTQKVADELGFPKDSYTIIKLDLGYLDSVRRFVAQFRELGRPLKALVCNAAVYFPLLDEPLWSADDYELSVATNHLGHFLLCNLLLEDLKACPDADKRLIILGTVTANSKELGGKIPIPAPPDLGNFEGFEAGFKKPIAMINNKKFKSGKAYKDSKLCNMLTTRELHRRFHQETGIVFNSLYPGCVADTPLFRNHYSLFRTIFPWFQKNVTKGYVSQELAGERVAMVVADDKFKDSGVHWSWGNRQQAGREAFVQELSEQGSDAQKAQRMWDLSEKLVGLV

SEQ ID NO: 19628 - protein, 170 aa, Oryza sativa (indica cultivar-group)
MAAAAQAPAAAKVVVSTSPRAGGGGGGGGDRKVVPVVVAAAAGDEAQSEMHVLAVDDSSVDRAVIAKILRSSKYRVTTVESATRALELLCLGLVPNVNMIITDYWMPGMTGYELLKRVKESSQLKEIPVVIMSSENVPNRISRCLEEGAEDFLLKPVRPSDVSRLCSRIR

SEQ ID NO: 19629 - protein, 429 aa, Bacillus cereus G9241
MKKFDKSIAAFEEAQDLMPGGVNSPVRAFKSVGMNPLFMERGKGSKVYDIDGNEYIDYVLSWGPLIHGHANDRVVEALKAVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLEFFAAYYREMVEQGVFLPPSQFEGLFLSTAHSDADIEATIAAAEIAMSKLKA

SEQ ID NO: 19630 - protein, 509 aa, Bacillus anthracis str. 'Ames Ancestor'
MRKPTALIILDGFGLREETYGNAVAQAKKPNFDGYWNKFPHTTLTACGEAVGLPEGQMGNSEVGHLNIGAGRIVYQSLTRVNVAIREGEFDKNETFQSAIKSVKEKGTALHLFGLLSDGGVHSHMNHMFALLRLAAKEGVEKVYIHAFLDGRDVGPKTAQSYIDATNEVIKETGVGQFATISGRYYSMDRDKRWDRVEKCYRAMVNGEGPTYKSAEECVEDSYANGIYDEFVLPSVIVNEDNTPVATINDDDAVIFYNFRPDRAIQIARVFTNGDFREFDRGEKVPHIPEFVCMTHFSETVDGYVAFKPMNLDNTLGEVVAQAGLKQLRIAETEKYPHVTFFFSGGREAEFPGEERILINSPKVATYDLKPEMSIYEVTDALVNEIENDKHDVIILNFANCDMVGHSGMMEPTIKAVEATDECLGKVVEAILAKDGVALITADHGNADEELTSEGEPMTAHTTNPVPFIVTKNDVELREDGILGDIAPTMLTLLGVEQPKEMTGKTIIK

SEQ ID NO: 19631 - protein, 529 aa, Frankia sp. CcI3
MPVVLVAEELSPAGLEVLSGDFEVRHVDGADRSALLPAIADVDAVIVRSATKIDAEVLATAGKLKVVARAGIGLDNVDVAAATQRGVMVVNAPQSNIVSAAEHAIALLLAVARRVPAASEALRGGEWKRSKYVGVELVEKTAGVVGLGRIGVLVAQRLAGFGMKVIAYDPYVSVARAAQHGVTLVDLDELLRQSDVITIHLPKTPETLGLIGTDELARTRPGVIIVNAARGGLVDEAALAEAVRSGQVGGAGIDVFAKEPTTASPLFGLDNVVVTPHLGASTQEAQDKAGLAVARSVRLALQGEFVPDAVNVQAGGVVAEDLRPGLPLAEKLGQLFSGLAGSLAAAITVEVRGEIAVHDVSVLQLAVLKGVFTDVTEEQVTYVNAPLLAKERGVDVALETAEDSPDYHNLVTVRGVLADGTPVSVSGTLVGSRQVEKITAIDGFEVDIRPEAHLAFFRYEDRPGIVGAVGALLGEAHINIASAQVSRLQAGGEALMSLSLDDAVAPDILAEIAKIIGASYARAVSISSD

SEQ ID NO: 19632 - protein, 462 aa, Geobacillus kaustophilus HTA426
MTDSGKQSFITDIHQLDKKGAGQAVVWQEEEGRRKKLKLTVPSTLPGEKVRVLIDWPKRRRAHARVEEVIEPHPERLAPSCPHFDRCGGCVWQHWRYEGQLRHKTEHVKTLLKEHGFDPGVVRDTIGMEHPWHYRNKMEFTFSPEGLLGLHERGNFRQVISLETCLIAGEKIVKAAMEVARWARDHRLPGYHKDTHEGLLRHLMVRESFATGEVMVALFATEAPEGDLKEAAADLTERITKMLPQVKSLLWLENRAWADRTQAEQTHVLAGRDFIYDELCGFRYRLWFDTFFQTNPVQAAKLVELALEMGKPQPHENMIDLFCGVGTFSLPFAKRVKALAGIEIVETSIESAKRNAKDNGIDNTYFLARDARRGIDEVLEQFGRPELLLLDPPRSGAGGKVMRKIGRARPERVVYVSCNPETFASDITELVSFGYTLKTVQPVDMFPHTAHVECCALLVRGS

SEQ ID NO: 19633 - protein, 566 aa, Oryza sativa (indica cultivar-group)
MNELCDLKVHINGHHTLLLHQSVMCAFSGRLRTMVTQEKKKRKTSRAESLSVKLADFPGGGEGFELVARFCYNNGRVPLCPSNLPLLHCAAVFLEMTEEVCTCNLLTQAEAFVDGLYYWTWADVLAAVKSCEPFAAAADASGLLERLISALFSKITANPETPVAAGAVGTPNRSSSSCSSSPDTLGFGRSSSTKTPESMKPCFAREWWFDDMTSLCPQTIEKAMRVLGCYGIENKNLILTRFLLHYLRAATRRPALCREGGGGLAGLADTAVHGVALVGGTAFSCRGLFWVLRIVSAVGLSKECRHKLERLMGLMLDQATLDDLLVSGDDGGVYDVNLVMRLVRVFVGSEEEADLPSQRMRKVGRLVDKYLGEISPDHGLRVSKFLAVAESLPDSARECYDGVYRALDIYLESHPTLTIEERTTLCRCLNYEKLTLEACKDLAKNRRIPPGIAVQALASQQSKLQIRPAAAAAKGTGGGRPDPSQTPRKIIVSGSRARSVDLDAMDEKELLKLNLQKMQNRVVELERACKEMRGQMSKMAKGGRPSSSFGAAACHQTGGRGLPRLC

SEQ ID NO: 19634 - protein, 335 aa, Schizosaccharomyces pombe
MAIPKVGINGFGRIGRIVLRNAILTGKIQVVAVNDPFIDLDYMAYMFKYDSTHGRFEGSVETKGGKLVIDGHSIDVHNERDPANIKWSASGAEYVIESTGVFTTKETASAHLKGGAKRVIISAPSKDAPMFVVGVNLEKFNPSEKVISNASCTTNCLAPLAKVINDTFGIEEGLMTTVHATTATQKTVDGPSKKDWRGGRGASANIIPSSTGAAKAVGKVIPALNGKLTGMAFRVPTPDVSVVDLTVKLAKPTNYEDIKAAIKAASEGPMKGVLGYTEDSVVSTDFCGDNHSSIFDASAGIQLSPQFVKLVSWYDNEWGYSHRVVDLVAYTASKD

SEQ ID NO: 19635 - protein, 743 aa, Oryza sativa (japonica cultivar-group)
MELLCIGTADTKLDELLFLAARLRSTLAATSSAQVQVSLVDVSTTKKVTSQDFKGTTFISRDAVLSCHLGVDQHELPSDRGEAITLMSEALQSFLKRRYESGTLLGAVGLGGSGGTALIAPALRSLPLGVPKLIVSTVASGQTAPYVGTSDLVLFPSVVDICGINSVSRVILSNAAAAVAGMVHGILMESNESDETATKPTIGITMFGVTTTCVNMVKERLSKEGYETLVFHATGVGGKAMEELVKGGFIQGVLDITTTEVADHIVGGVMACDDTRFDAIIDNKIPLVLSVGALDMVNFGARDTIPPDFTGRKIHVHNEQVSLMRTTVEENKKIAEFIADKINKSSSKVIVCLPQKGISAIDAPKMPFYDLEATSTLLDELCSRIEKTDNREVKMLPYHINDPEFANVLVDAFLSMDVKASNTISPENSMVQTNQDVNTKEYCSTQRTSDSSIIWRSPVDFPDARPETLQKTKSVLHKLKQQIVEGTPVIGAGAGTGISAKFEEAGGVDLIVLYNSGRFRMAGRGSLAGLLPFADANAIVLEMANEVLPVVKGVPVLAGVCATDPFRRMEYFLKQLEAIGFCGVQNFPTVGLFDGNFRQNLEETGMGYSLEVEMISRAHSMGFLTTPYAFNPEEAAAMAKAGAHIIVAHMGLTTAGSIGAKTAVTLDDSVKRVQAIADAALGINPDIIVLCHGGPISGPQEAEFILKRTNRVHGFYGASSMERLPVEQAITNTMREYKRISIK

SEQ ID NO: 19636 - protein, 135 aa, Arabidopsis thaliana
  misc_feature (6)..(6): Xaa can be any naturally occurring amino acid
  misc_feature (90)..(90): Xaa can be any naturally occurring amino acid
  misc_feature (101)..(101): Xaa can be any naturally occurring amino acid
  misc_feature (103)..(103): Xaa can be any naturally occurring amino acid
  misc_feature (110)..(110): Xaa can be any naturally occurring amino acid
  misc_feature (114)..(114): Xaa can be any naturally occurring amino acid
  misc_feature (117)..(118): Xaa can be any naturally occurring amino acid
  misc_feature (122)..(123): Xaa can be any naturally occurring amino acid
  misc_feature (125)..(126): Xaa can be any naturally occurring amino acid
  misc_feature (132)..(133): Xaa can be any naturally occurring amino acid
  unsure (1)..(135): unsure at all Xaa locations
MASSMXSSTAVVTSPAQATMVAPFTGLKSSASFPVTRKANNDITSITSNGGRVSCMKVWPPIGKKKFETLSYLPDLSDVELAKEVDYLLXNKVGSLCLNSXLXHGFFYRXHGNXPGXXFIGXXWXXWEVPFXXCT

SEQ ID NO: 19637 - protein, 483 aa, Streptomyces avermitilis MA-4680
MTSSQVDKQYDGNGAVGGDAPEEGYERGLGSRQVQMIAIGGAIGVGLFLGAGANIAKAGPSLILMYALAGVIIFFIMRALGELLLYRPVSGSFAEYSREFLGPFFGYFTGWTYWLMWVVTGMAELTAAAIYVHYWFPAVPQWVTALVFLVVLFVANLISVKLFGEIEFWFSMVKVTALIGMIVIGLGVLTFGFSSAGDTASVANLWQFDGFFPKGIGSSLMTLQGVMFAYLAVELVGVTAGESEDPEKTLPKAINTLPWRIALFYVGALTVILCVVKWTEFAPGVSPFVKAFAMIGIPAGAGIVNFVVLTAALSSCNSGMYSTGRMLRTLADNGEAPRVFSKLSASKTPAFGITISVLFMGIGVILNYVVPEKAFGYVTSVATAAGIWTWLMILVSHVLYRRAVDAGRLPASSFPAPGGAKCSWVAIVFLLFVTGLIAYDADSRVCLYVMAVWAAALAIGWYVLKARNPQVAERHEPKFEKVG

SEQ ID NO: 19638 - protein, 585 aa, Coccidioides immitis RS
MYNRAMVPAPNPRLTELFDQLRQEYENQSRSHGECEHQLTGQLQEMEMIRQRVTQLEQAHIDMKQKYEAEIRGLRMELESRGIHLPPSHVGGPPTHGGLSQAPPPALGHGPSNLFGGIIANQGGGPPALAPPPPQDQQQPPQHSLQPPASGAQGPPQPQQGAFGGYQPNSAVNGYGPPPPAPTSSPGPGKGRANRAPPGPATPQQNQPVAYADPRESPQIPQPTPGQPIPYRVGNALGELEPDKLPPTQKKEGTDWYAVFNPEIPRVLDVELVHTLSHNSVVCCVKFSSDGKYVATGCNRSAQIFDVASGQLVTTLQDDTANKEGDLYIRSVCFSPDGKFLATGAEDRQIRVWDIANRKIRHIFAGHENDIYSLDYSRNGRYIASGSGDKTVRMWDVYDGKQELILSIEDGVTTVAISPDGRYVAAGSLDRSVRVWDTTTGYLVERLESPDGHRDSVYSVAFAPNGRDLVSGSLDKTIKMWELTPPRGIMAGSGPKGGKCVRTFEGHKDFVLSVCFTPDGHWVLSGSKDRGVQFWDVMTGHAQMMLQGHRNSVISVAPSPTGQLFATGSGDCRAKIWSYGPWGRR

SEQ ID NO: 19639 - protein, 177 aa, Zea mays
MSGFAAHLVLLLLVLVSVSLSPSVRCLGKERTLAMIKPDGVSGNYTEEIKRLIVEAGFNIVKERLTQLEKEAASAFYDEHSSRSFFPHLVSYMTSGPVVVMVLEKGDAVSDWRGLIGPTDSQKAKISHPHSIRALCGKDSQRNCVHGSDSTSSAEREINFFFKDVVSGDIASQHDEL

SEQ ID NO: 19640 - protein, 393 aa, Listeria innocua
MDLPLSKRVKGVAPSPTLAITAKAKQMKQEGIDVIGLGAGEPDFNTPQNIIDAAIESMNKGFTKYTPSSGILELKQAIVDKLKKDQSLTYEANQIFVGTGAKHVLYSAFQTILDPGDEVIIPVPYWVTYPEQVKLAGGVPVFVETGFDADFKISATDFEHAITEKTKAIVLNSPNNPSGMCYTKDELAAIGAVAEKHQIYILSDEIYEKLYYGNKADLVSIASLSDRLYDLTIVINGVSKAYSMTGWRIGYAAANKEIIAGMSKLADHLTSNPTANAQYAALEAYVGSQEVPEKMYKAFEERMERFYPELSSIPGFKPKKPDGAFYFFIEVKEAAHKKGFQDVDAFVAALLEEAKVAVIPGSGFGMPDYIRLSYATNPDLFQEAINRIKSFMK

SEQ ID NO: 19641 - protein, 719 aa, Cryptococcus neoformans var. neoformans B-3501A
MGKGKNHDRKANPGFGKVKSKSGTSTGEFTLKRVKGENFYRDAKSAARVKMLNGGKAVRDRDGKIVEAAAFQKGEKDAEPGRVKPDRRWFGNTRVISQSALDHFRTALKEQKTDPYSVLLKRNKLPMGLLQDDTKDGGRRPHIVETEPFGNTFGPKAQRKRPKLDIGSIEELGESSAAAAAETAAATAESQGSGTADLADIYHPTTSTAREPIYAKGTSRRIWGELYKVLDSSDVVIHVLDARDPLGTRCKPVVEYLRKEKAHKHLVYVLNKVDLVPTWVTARWVKHLSLSAPTIAFHASINNSFGKGSLIQLLRQFSVLHSDKKQISVGFIGYPNTGKSSIINTLKKKKVCTVAPIPGETKIWQYITLMRRIYLIDCPGIVPVSAKDSDTDTVLKGVVRVENLATPAEHIPALLERVRPEYLERTYGLERVEGGWHGEEGATVILTAIAKKSGKLLKGGEPDQEAAAKMVLNDWIRGKIPFFVAPPSKPEPGAASAHASSATATATTEADKKAEEAQEQQELAEEKETKEMLEEQERSLGKVLGIKRVKGVEQPISKIVTMTKFLGDDARRYVEEEEEASVDDEDREMAEEEEEESGEDQEEEELAWDDVFPEEAAGGDAADGEEVVEEEEEDEEDDGEDEDVPSAKQLGKRKAIDSDEEEQTATKAKRMTTSKQKASNFYTHANVKNRNRDRKVPKNPGKRSRGDDEPTGKKAKKRR

SEQ ID NO: 19642 - protein, 468 aa, Pseudomonas putida KT2440
MTDSVEKIQLTRALKSRHIFMLSLGGVIGTGLFMGSGVTINQGGPVGAILAYLVAGLLMYLVMVCLGELSVQMPVSGSFQAHATKYIGPATGFMIGWVYWMSWATTVGLEFTAAGMLMTRWFPEVPIWYWSALFVVVLFGLNALATRAFGEAEYWFSGIKVATILGFIVIGLLVIFGAIPLSSGAPAPMLNNLVGESLFPHGLSAVFAVMMTVVYAFQGCEIMGVAAGETEHPEKSIPRAVRNVVFRVLIFYVLAIAVLSAIVPHEQAGLMESPFVQVFDMVGIPYAADLMNFVILTAILSVGNSGLYASTRILWAMSKTGMAPKSLSPLSKRGVPLRALSITLCFALISLMTSFVAADTLFMVLMAVSGMSGTVTWIVIALAQYRFRKAWLRDGGQLQDLKYKAPLYPLVPLLCITLCSSLFVFLALDETQRPSLYWGFGFIALCYAAYFFVNRRRQGAFAPSTPGV

SEQ ID NO: 19643 - protein, 417 aa, Alkalilimnicola ehrlichei MLHE-1
MREFKSYTVNFGPQHPAAHGVLRMVLEMEGETVRRADPHIGLLHRATEKLAESKPYNQSIGYMDRLDYVSMLCNEHAYVMAIEKLLGIEAPIRAQYIRVMFDEITRILNHLMWLGAHGLDVGAMTAFLYCFREREDLMDCYEAVSGARMHAAYYRPGGVYRDLPESMPKYEPSKFRSKKELELMNAARQGTMLDFIEDFTERFPGCVDEYETLLTENRIWRQRLVDVGVVSPERALQLGFSGPMLRGSGIEWDLRKKQPYDVYDRVEFDIPVGTNGDCYDRYLVRIEEMRQSNRIIKQCVDWLRHNPGPVMLEDHKVAPPSREEMKDDMESLIHHFKLFTEGYTTPPGEVYAAVEAPKGEFGCYMISDGANKPYRVKLRAPGFAHLSAMDEMARGHMLADVVAIIGTQDIVFGEIDR

SEQ ID NO: 19644 - protein, 419 aa, Arabidopsis thaliana
MVSYRATTETISLALEANSSEAITILYQVLEDPSSSPEAIRIKEQAITNLCDRLIEEKRGEDLRKLLTKLRPFFSLIPKAKTAKIVRGIIDAVAKIPGTTDLQITLCKEMVEWTRAEKRTFLRQRVEARLAALLMENKEYVEALALLSTLVKEVRRLDDKLLLVDIDLLESKLHFSLRNLPKAKAALTAARTAANAIYVPPAQQGTIDLQSGILHAEEKDYKTGYSYFFEAFESFNALGDPRAVFSLKYMLLCKIMVSQADDVAGIISSKAGLQYVGPDLDAMKAVADAHSKRSLKLFENALRDYKAQLEDDPIVHRHLSSLYDTLLEQNLCRLIEPFSRVEIAHIAELIGLPLDHVEKKLSQMILDKKFAGTLDQGAGCLIIFEDPKADAIYSATLETIANMGKVVDSLYVRSAKIMS

SEQ ID NO: 19645 - protein, 240 aa, Brassica napus
MVAQGFTVDLDKPLAFQVGHLGEAYDEWVHQPIVTKEGPRFFHNDFWEFLTLTVWWAVPVIWLPVVVWCISMSGSMGCSFPEVVSLVALGIFIWTFIEYCLHRFLFHMKTKSYWGNTAHYLIHGYHHKHPMDHLRLVFPPALTAIMCFPLWNLAKLIATPSAAPALFGGGLFGYVMYDLTHYYLHHANPTIPVTKNLKKSHLNHHFRIQDKGYGVTSSLWDIVFGTLPTTKAIKREQQKY

SEQ ID NO: 19646 - protein, 260 aa, Triticum aestivum
MAPSIAPPSSPSCLRGKLFPRFTGTNSQPMNSVLRCDISVSPTLASNSLRRTSSVHLANNNRIKSFHVCHAGVDPSERIVINGQASPSKTVQADAAALGTISADMAPVVDGFSADDDELDLDLPTEGFSSIPEAIEDIRQGKYVIVVDDEDRENEGDLIMAASTVTPEAMAFIVRHGTGIVCVSMKEDDLERLQLPLMVVAKENEEKLRTAFTVSVDAKEGTTTGVSAKDRANTVLALASPYSKPEDFNRPGHIFPLKYR

SEQ ID NO: 19647 - protein, 292 aa, Leuconostoc mesenteroides subsp. mesenteroides ATCC 8293
MDYKTLASGIEMPLLGFGVFQVQEKGAAKQAVLDAIKTGYRLIDTAASYGNEREVGEAILEAINQGIVKREELFVTSKMWVQDVSAQQATAAIQSSLQRLNLDYLDLYLIHQPYNDVFGAWRAMESAYRSGQLKAIGVSNFDIAQLTNLAEFSDIKPMLNQIEVNPFQQNKKDITYFSQYGVQVEAWAPFAEGKNDLFSNILLRKIADKHHKSIAQIVLRWLTQRNIIVVAKSVKPERMAQNLDIFDFKLTHQELAEIETLDTNSSQFFNHADPDMIKWMANREISYDVTFN

SEQ ID NO: 19648 - protein, 277 aa, Listeria innocua
MKKPVDFFAMKENGEKITMITAYDYPSAKNVEQAEADMILVGDSLGMVVLGYDSTVPVTMNDMIHHTKAVKRGAPNTFVVTDMPFMTYHGSVDETIQNARKIIQESGAHAVKLEGAGEVVNKIARLTEAGAPVVAHLGLTPQSVGLTGSYKVRAKSVQEAQELIDNALAVEAAGAIAIVLEAIPRQLAEKVTKALTIPTIGIGAGLETDGQVLVYHDIIGYGINRRAKFVKAYADIDETIEPALKNYVNDVKELAFPEVKHSFTMAEEDLKGLYGRE

SEQ ID NO: 19649 - protein, 325 aa, Listeria innocua
MKNNREKLLALFTESDGAYLSGQEIADSLGCSRTAVWKQMEALRKEGFEIEAVRNRGYRLSATAEQYTKDALLLGLETKFIGQHLEIYESVNSTQIIAHQQMNSSPEGTVIVADEQTAGKGRLLRPWNSKKGEGIWMSVILKPQIPIQKVPQFTFIASLAITEAIENITKLEPKIKWPNDIYIGKRKICGVLTEMQAEAETIHAVIIGMGINVNQQEFPEEIKEKASSLKLELGESVSRKALLQAILTSLEKYYELFLDKGFAPIKLLWETKAIPFGEKLTASTTKGKIHGQVKGISDEGVLLLQDSLGEIHSIYSADILLDNEK

SEQ ID NO: 19650 - protein, 419 aa, Arabidopsis thaliana
MVSYRATTETISLALEANSSEAITILYQVLEDPSSSPEAIRIKEQAITNLCDRLTEEKRGEDLRKLLTKLRPFFSLIPKAKTAKIVRGIIDAVAKIPGTTDLQITLCKEMVEWTRAEKRTFLRQRVEARLAALLMENKEYVEALALLSTLVKEVRRLDDKLLLVDIDLLESKLHFSLRNLPKAKAALTAARTAANAIYVPPAQQGTIDLQSGILHAEEKDYKTGYSYFFEAFESFNALGDPRAVFSLKYMLLCKIMVSQADDVAGIISSKAGLQYVGPDLDAMKAVADAHSKRSLKLFENALRDYKAQLEDDPIVHRHLSSLYDTLLEQNLCRLIEPFSRVEIAHIAELIGLPLDHVEKKLSQMILDKKFAGTLDQGAGCLIIFEDPKADAIYSATLETIANMGKVVDSLYVRSAKIMS

SEQ ID NO: 19651 - protein, 283 aa, Yersinia pseudotuberculosis IP 32953
MQTVKLNNGIAMPLLGFGVFQMTNTAECERAVIDAIETGYRLIDTAASYQNETQVGNALKLSGIARDELFITTKLWLQDTSYEGAKAQFERSLNRLQLDYVDLYLIHQPYGDVHGAWRAMEELHQAGKIRAIGVSNFHPDRLADLMAFNKIIPAVNQIEVNPFNQQLHAVPWMQSRGIQPEAWAPFAEGRNGLFQNPVLTAIGEKYGKSVGQVVLRWIFQRGIVSLAKSVRKGRMEENINILDFELSAEDMLQIAALDTATSAFFSHRDPAMVEWLTGRKLDV

SEQ ID NO: 19652 - protein, 400 aa, Roseovarius nubinhibens ISM
MRYSKTITGLTGGGSDGWDIYRKARRMQRDGTEVTMLTIGEHDIRTDAQILDALHRFAHAGHTGYTTFDGEPELKDRIATRLSERTGVPTTPANVLIVPGGQGGLFAAHHAICDPGDTALYIDPYYTTYPGTIRTVGAIPLAIEARPRHGFQPQPEDIARAADAAGNARSLLVNTPNNPTGVVYTRKTLEGIAEICTDKGLWLLSDEVYDTQVWNGDHLSPRALPGMAERTLVIGSMSKSHAMTGSRVGWVVGPEEAIAHMANLATHTTYGISGYIQHAAAFALDLGPAFEEQIAEPFRRRRDLVMAQMEGQNAARPIPADGAMYVMVDIRSTGLSGEAFADGLLDRHHVAVMPGESFGQAAAGHVRVALTVADDLLVAAVARLVELAAELAAQHAEPAQ

SEQ ID NO: 19653 - protein, 399 aa, Arabidopsis thaliana
EAITILYQVLEDPSSSPEAIRIKEQAITNLCDRLTEEKRGEDLRKLLTKLRPFFSLIPKAKTAKIVRGIIDAVAKIPGTTDLQITLCKEMVEWTRAEKRTFLRQRVEARLAALLMENKEYVEALALLSTLVKEVRRLDDKLLLVDIDLLESKLHFSLRNLPKAKAALTAARTAANAIYVPPAQQGTIDLQSGILHAEEKDYKTGYSYFFEAFESFNALGDPRAVFSLKYMLLCKIMVSQADDVAGIISSKAGLQYVGPDLDAMKAVADAHSKRSLKLFENALRDYKAQLEDDPIVHRHLSSLYDTLLEQNLCRLIEPFSRVEIAHIAELIGLPLDHVEKKLSQMILDKKFAGTLDQGAGCLIIFEDPKADAIYSATLETIANMGKVVDSLYVRSAKIMS

SEQ ID NO: 19654 - protein, 279 aa, Lactobacillus johnsonii NCC 533
MATIQWYPGHMNKAKNQLEDNLDLIDVLIEVLDARLPVSSRNPMIGQLTKKKPHIIVLNKADLADPIQTKKWTHYYQDEGNFVISMDAQHTTNMTSLFKIIKLAGKEKTDKLIAKGASNPMIRVAIAGIPNCGKSTIINRMVGRNAAIVGDKPGVTRGQSWLKTKTNVQILDTPGILWPKFSDQEVGYKLAACGAIKADIFHPDDVALFVIEFLKQNYRDDLVKFARISSEEMDSMSNPDLLLAMTNKYGMRDDYDKFSLFMLQRLRKGKLGRITFDLR

SEQ ID NO: 19655 - protein, 527 aa, Glycine max
MPSSHLLLEEPIRMVSILEPSKPSFFSAMTKIVGTLGPKSRSVETISGCLKAGMSVARFDFSWHDPEYHQETLENLKAAIKSTKKLCAVMLDTVGAEMQVVNKSERAISLEANGLVVLTPDQGQEASSEILPINFDGLAKAVKKGDTIFIGQYLFTGSETTSVWLEVSEVKGQDVVCIIKNTATLAGSLFTLHASQIHIDLPTLTEKDKEVISTWGVKNKIDFLSLSYTRHAKDVRQAREFLSKLGDLSQTQIFAKIENVEGLTHFDEILQEADGIILSRGNLGIDLPPEKVFLFQKSALYKCNMAGKPAVLTRVVDSMTDNLRPTRAEATDVANAVLDGSDAILLGAETLRGLYPIETISTVGRICSEAEKVFNQDLYFKRTVKYVGEPMTHLESIASSAVRAAIKVKASIIICFTSSGRAARLIAKYRPTMPVLSVVIPRLKTNQLKWSFSGAFEARQSLIVRGLFPMLADPRHPAESTSATNESILKVALDHGKSLGVIKSHDRVVVCQKLGDASVVKIIELED

SEQ ID NO: 19656 - protein, 268 aa, Prochlorococcus marinus subsp. pastoris str. CCMP1986
MTSKIAVIGFGNIAKAIITPLFDKKLLKPKDVYCLVNTKKSLENIRKNYKYDINIFQANSKGSEIIWDCEVKFLSVKPQQLKNIIELEKNKNYLLVSILAGVSLEKLIKKFPNHKCVRVVTNIPITIGKGLTGISWGDEIKEAQKQFIKRLFENSSKIYEFPEDLLDIFLSLTSSGPAIVALIIEALSDGGLSGGLQKRLSEELVVEMILGTVSLIKETNLTTAELKNMVTSPGGTTISALRVLENRSLRSALIEAVVSASNRSKEFR

SEQ ID NO: 19657 - protein, 296 aa, Medicago truncatula
MVARGDLGAELPVEEVPLLQEDIIRRCHRMQKPVIVATNMLESMIIHPTPTRAEVSDIAIAVRKGADAVMLSGETAHGKYPLKSVKVMHAVALRNESSVLRSDSYPNHLSFHKSHMGAMFAFHATIMSNTLNTPIIVFTRTGSMAILLSHYRPHSTIFAFTNEGRIKQRLGLYHSVMPIYMQFSNDAEETFARALKLLLIKGHLNEGQYVTLVQSGAQPIWREESIHHIQVRKDGIRYVAANSDFFGLIVPNIKETSHVGNPNSIFNSIFINGTYKWDRREVSWDPKTVAVSLRFS

SEQ ID NO: 19658 - protein, 325 aa, Medicago truncatula
MTTIHLSSTTSSLFKSNNLNNLSSSNFISFHSIKHPSKRVPQITSSNQSPTLGNDYYTNSSSLYGTWRTGEGSDERTKTKIVCTIGPSTSSRDMIWKLAETGMNVARLNMSHGDHTSHQKAIDFVKQYNSQFQDRVISIMLDTKGPEVRSGDVSQPILLKEGQTFNFTINRGVSTQDTVSVNYDDFVNDVEVGDVLLVDGGIMSLVVKSKTKDLVKCEVIDGGELKSRRHLNVRGKSATLPSITEKDWEDIKFGVDNEVDFYAVSFVKDARVVYELKEYLKRHNADIHVIVKIESADSIPNLHSILSASDGVSSSLFKLYIVCIF

SEQ ID NO: 19659 - protein, 264 aa, Helicobacter hepaticus ATCC 51449
MLDKKMSIATLKAKKGIEKITAITAYDALMARIFDGEVDVILVGDSLKMSFGGENETLGASMQEMIYHTKAVCKGAKHSFIIADMPFGSYATPNMALKNALRFYKNTAADALKLEVGIDKLPVVKVLCEEGIAVMAHIGLKPQFMRFDGGFKIKGKDEVESQELIEAAVAFQEAGVFGILIEGVKSESGARITQALEIPTIGIGAGVECDGQILVWSDAFGFFDEFKPKFVRRYCDGKAILKDAIRAYAKDVKSQAFPQAQESY

SEQ ID NO: 19660 - protein, 223 aa, Ustilago maydis 521
MFARSAIPTLRAASVRAFSTQTASTGTASARRYMGAAALAAGGALTYSAFAAPTVHLEGPKTIAGELGTSTERSYVMIKPDGVSRQIVGEIISRFEKRGYQLVALKTVIPSAELAKEHYIDLAKKPFYGGLVKYITSGTPVVAMVWQGKDVIRQGRRLVGATNPLDAAPGSIRGDFCVSVGRNIIHASDSHESATKEIGLWFHEKELATEYKPIAWDMIMADN

SEQ ID NO: 19661 - protein, 288 aa, Rhodospirillum rubrum ATCC 11170
MSDPIDVAAETPGDGLPPLREVIATHGLDARRSLGQNFLFDLNLTGRIARAGGEIDQGTVIEIGPGPGGLTRALLGAGARRVIAIERDSRCRGVLAEIAAVWPGRLETIEGDALDIDVAALGEAPRRVIANLPYNVATPLLIGWLRHASAFERFVLMFQKEVVDRLAARPGTKDYGRLSVITQWLCEVRPLFDVNPRAFTPPPKVVSTVVRIDPRPQPLAPARMETLERVTAAAFGQRRKMLRASLKALGDAEGLCAAAGLDPTARAETIPVEGFAALARAVDAAGSV

SEQ ID NO: 19662 - protein, 317 aa, Oryza sativa
MSPPPSSLLPSPLPSPPILLSTNPSSLRLPPLAAGRRGAERAVAAAAASAPAPATPVQAQQRASRPSAAEVARTVVELAPSGTLSVVGPDGWPLGVGARFVADGSGAPALCLAASGPAAAAPDAPSSFHVEFRQSGARTPQCTLLGALTKPNDEYELKKLSTRWQKKFGEEIDQDLLYLISVDRILHIEDFNEDGMWVIPSEYSDAEPDPLRNFAESIVEEMNSKHAEDVHRIYSIYVESDFQATEVKMIWVDRLGFDLHVHSGEGTFAARIPFTREVSDEKGVKSSFNMMSHHAWEVEKSYAAPEFEKVELLKKVR

SEQ ID NO: 19663 - protein, 148 aa, Ustilago maydis 521
MDAHDIVSNIAFTTSGSLVDCVDKKMLVVLRDGKKLIGVLRSYDQFANLVLQDTVERVFVGNRYGDVARGIFLVRGENVVLMGEIDLDAEDEVPPSIAAPLPPSALPQLLAAKEAEAESKAKSEAKKADILRIAQGFCADKSGDGDMY

SEQ ID NO: 19664 - protein, 301 aa, Triticum aestivum
  misc_feature (240)..(240): Xaa can be any naturally occurring amino acid
  misc_feature (259)..(259): Xaa can be any naturally occurring amino acid
  misc_feature (281)..(281): Xaa can be any naturally occurring amino acid
  unsure (1)..(301): unsure at all Xaa locations
MDGGGGVGGGMGPVGGGVGGMVGPVGVGGGGGGSDVELVSKTLQFEHKLFYFDLKENPRGRYLKISEKTSTTRSTIIVPIAGVGWFLDLYDYNIRTDERDVFSKELRLDSKVFYFDMGENKRGRYLKVSEASVNRNRSTIIVPAGSSGEQGWEAFRNVLLEINDEASRLYVLPNHPSQEHLEPPERLRGLSDDVGAGLIAGHGRQSASVPEVDVEGPPIEEFIVVGVPQVIRADHQRVFXDLGRKNRGHLVEGFRRTRXAYSSPKILPLTGWKQSNPRVGXFGDLRRDEVNGMRGGTSPLG

SEQ ID NO: 19665 - protein, 478 aa, Rubrivivax gelatinosus PM1
MTMHRATKIVATLGPASSTPDVLERMITAGVDVVRLNFSHGSAQDHIARAALVREVAQRAGKEVAIMADLQGPKIRVGKFAQGKVMLEPGAAFVLDAARSEPGDLQAVGLDYKSLPRDVKPGDTLLLNDGLIVLTVDKVIGEAVHTVVKIGGELSNNKGINKQGGGLTAPALTAKDMEDIKTAMSFQCEYLAVSFPKSATDMEMARQLANVAGEPWRHKPALIAKIERSEAIPVLEQILKASDGIMVARGDLAVEVGNAAVPALQKKMIKLARELDKVVITATQMMESMIVNPVPTRAEVSDVANAVLDGTDAVMLSAETAAGKYPVETIEQMAAIALAAERAEDVALDADFTNKRFGRIDQSIAMGALFTAHHLGCKAIVALTESGSTALWMSRHKIHVPIFALTSQQTSQRKMTLYRNVRPLLMPSYTDRDEALAKAEALLVDGGVLKPGDTYAITCGEPMGYPGGTNMLKVCRVA

SEQ ID NO: 19666 - protein, 282 aa, Bacillus subtilis subsp. subtilis str. 168
MTIQWFPGHMAKARREVTEKLKLIDIVYELVDARIPMSSRNPMIEDILKNKPRIMLLNKADKADAAVTQQWKEHFENQGIRSLSINSVNGQGLNQIVPASKEILQEKFDRMRAKGVKPRAIRALIIGIPNVGKSTLINRLAKKNIAKTGDRPGITTSQQWVKVGKELELLDTPGILWPKFEDELVGLRLAVTGAIKDSIINLQDVAVFGLRFLEEHYPERLKERYGLDEIPEDIAELFDAIGEKRGCLMSGGLINYDKTTEVIIRDIRTEKFGRLSFEQPTM

SEQ ID NO: 19667 - protein, 250 aa, Alkalilimnicola ehrlichei MLHE-1
MRKPMVAGNWKMNGSLALVNDMGRALADVDCSAVDVLVCPPFPYIGPLRRAVPDESGVALGGQDVSRYDSGAYTGEVAGAMLAEMGCRHVIVGHSERRAMHAETDEVVVDKVQAALRAGLTPIVCVGETLEARDAGETEQVVGRQLDAVLELGGFVVEKLVLAYEPVWAIGTGRTASPEQAQAVHAFIRQRAADALGDELAQRLPILYGGSVKPGNARELFGCADVDGGLIGGASLDPDGFLEIISAARP

SEQ ID NO: 19668 - protein, 250 aa, Methylococcus capsulatus str. Bath
MRRPLVVGNWKMNGRSASVARLLNDILAGIGDCKAEVGVCVPFVYIPQASEILKGTKVMLGAQNVADHNSGAFTGEISAGMLREFGCELAIVGHSERRLLYGESNELVASRYEQAIQGHLKPILCVGETLEQREQGRTLAVIGAQIDTVFEFAGVQSLEHAVIAYEPVWAVGTGRSATTGQAQEVHYHIRSLIARWNPEVAQAVQIIYGGSVKPENSAELFAMPDIDGGLIGGASLDARAFLSICHSVSV

SEQ ID NO: 19669 - protein, 775 aa, Desulfitobacterium hafniense Y51
MVLLREEISLSRAFINYADPKNRPAKQVYYFSMEFLIGKLLHNYLINIGIQDIVAEGLEELNIDLQELLAQECDAGLGNGGLGRLAACFLDSMAFLGIAGHGNGIRYKYGLFEQKIVNGYQTEVADHWLKNGYPWEVRKPDKSVVIKYKGKVRVENINDRLVFHHENYEPVLAVPYDIPIVSYENPFLVNNLRLWSAEPLSSELDLALFNQGNFTQALSNKSEVEAISYILYPEDSNLAGRELRLKQEYFFVAAGLATIVRNYKKNHGSLRDFSQGVSIHINDTHPALCIPELMRILIDEEGMDWEESWNITVDAISYTNHTIMPEALEKWPLDLFRNLLPRITMIIEEIDRRFKEKLLRRFFNSEELFRSTPIIKEGQIYMANLAMIGSHSVNGVAKLHTEILKKHVFKDFHRIFGYKFTNLTNGVNHRRFLLTANPLLSELITEGIGPGWKTNAGELAELHRFKEDSAFLDRLAQVKYQNKLRLAEIIAKGQGIQIDPHSLYDVHVKRIHAYKRQLLNVLKVMDLYNRLLADPGSVQGTYTFIFGGKAAPGYHYAKSIIKLIHVIADKINQEPRIKEQLKVVFMENFNVSSAERIYPAADLSEQISTAGKEASGTGNMKFMMNGALTIGTLDGANVEIREAVGEDHIFIFGLTAEEILAHNLNRTYRSWDEYHANPRLENILEQLISKQFMENDGEFRTVYDSLLLYNDEFFVLKDFAAYMKTFGEAADRYAAQEQWLRSSLHNIAESGVFSTDRTIREYAHQVWRVRCRRMD

SEQ ID NO: 19670 - protein, 569 aa, Salmonella enterica subsp. enterica serovar Paratyphi A str.
MSEEKLGQQYLAALHQAFPGVVLDEAWQTKDQLTITVKVNYLPEAVEFLYYQQGGWLSVLFGNDERQLCGHYAVYYVLSMEQGTKCWITVRVEVDANKLEFPSVTPRVPAAVWGEREVRDMYGLIPVGLPDERRLVLPDDWPDELYPLRKDSMDYRQRPAPTTDAETYEFINELGDKKNNVVPIGPLHVTSDEPGHFRLFVDGENIIDADYRLFYVHRGMEKLAETRMGYNEVTFLSDRVCGICGFAHSTAYTTSVENAMGIQVPERAQMIRAILLEVERLHSHLLNLGLACHFTGFDSGFMQFFRVRETSMKMAEILTGARKTYGLNLIGGIRRDLLKEDMIQTRQLAQQMRRDVQELVDMLLSTPNMEQRTVGIGRLDPEIARDFSNVGPMVRASGHARDTRADHPFVGYGLLPMEVHSEQGCDVISRLKVRINEVYTSLNMIDFGLDNLPGGPLMVEGFTYIPHRFALGFAEAPRGDDIHWSMTGDNQKLYRWRCRAATYANWPTLRYMLRGNTVSDAPLIIGSLDPCYSCTDRMTVVDVRKKKSKVVPYKELERYSIERKNSPLK

SEQ ID NO: 19671 - protein, 382 aa, Thermus thermophilus
  misc_feature (234)..(234): Xaa can be any naturally occurring amino acid
  unsure (1)..(382): unsure at all Xaa locations
MRGLSRRVQAMKPSATVAVNAKALELRRQGVDLVALTAGEPDFDTPEHVKEAARRALAQGKTKYAPPAGIPELREALAEKFRRENGLSVTPEETIVTVGGKQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAXAFAMTGWRIGYACGPKEVIKAMASVSSQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVL

SEQ ID NO: 19672 - protein, 234 aa, Fusobacterium nucleatum subsp. nucleatum ATCC 25586
MKFLKFDEIDSTNNYMKENIASFENYDIVSAKVQTSGRGRRGNVWLSPEGMALFSFLLKPEKTLSIIEATKLPLLAGISTLSALKKIKDGAYSFKWTNDVFFNSKKLCGILIERVKDDFVVGIGINVANKIPKDIKNIAISMESDYDIEKLILKVVEEFSVYYKRFSEGKWQEIIEEINSCNFLKDKKIRVHIGDKIFEGIAKNIVEDGRIEIKVDGEIKLFSVGEIKIEKGYY

SEQ ID NO: 19673 - protein, 261 aa, Corynebacterium diphtheriae
MLALLRFVANLTSMTTGKLILLRHGQSEWNASNQFTGWVDVNLTEKGEAEAKRGGELLKAQGVLPSVVYTSLLRRAIRTANIALNAADRHWIPVVRDWRLNERHYGALQGLNKAETKEKYGDEQFMAWRRSYGTPPPELEDSSEFSQANDPRYANLDVVPRTECLKDVVERFVPYFKEEILPRVKNGETVLIAAHGNSLRALVKHLDNISDADIAELNIPTGIPLVYELDEAGTVLNPGGTYLDPEAAAAGAAAVAAQGAK

SEQ ID NO: 19674 - protein, 303 aa, Nostoc punctiforme PCC 73102
MARITTPFGRHSTASEVAQGIDLSGKRAIVTGAASGIGVETARALAHAGAEVTLAVHNVDAGAKTAADITAITGNQNIHVAKLDLTDRGAIAKFIAAWNEPLHILVNNAGVMALPEQHTPEGWEMQFATNHLGHFALTLGLHDALAADGAARIVSVSSSAHMLSPIVFDDIHFAFRPYDPWLAYGQSKTANVLFAVAGTGRWFRDGITANALMPGAIATNLQRHVGGIQTPAELQKTPEQGAATSILLATSPLVEGIGGRYFEDCNEATIVTQQTKDYSGVAPYALNTNNADRLWEESLRLLA

SEQ ID NO: 19675 - protein, 270 aa, Corynebacterium diphtheriae
MFAMTSIAVIGGGKIGEALISGLVASGMSPKDIHVTNRNAERAQELKERYGVLTFLENIAAVDDVDMVFLCVKPQQVIPVVEEIADVVDNNTSTTIVSMAAGVTNAMIEESLAAGSPVIRVMPNTPMLVGKGMSVVAPGRYADEDTVASLTQLLEAVGSVEVIEESSMDAVVALSGSSPAYLFLMVEALIDAGVFLGLPRDKAKNLAVSSFAGAATMLEQTGEEPAVLRANVSSPGGTTIAAIREFEESGLRAAVYRAATAAATRNSSLG

SEQ ID NO: 19676 - protein, 493 aa, Lotus japonicus
MTEVLQLPSPSRRCSNDGSHQTALINNSSSVEEGVLQLQTHLDLVEEDEEEEKEKDREGDQLSLLTLLIATLRKSLIGSCSTSPRDSGALSSSSMEIGWPSNVRHVAHVTFDRFHGFLGLPVEFEPEVPRRPPSASTSVFGVSTESMQLSFDARGNSVPTILLLMQRHLYARGGLQAEGIFRINAENSQEELVREQLNRGVVPNGVDVHCLAGLIKAWFRELPTGILDPLSPEEVMQSQSEEECDQLVRLLPPTEAALLDWAINLMADVAQMEHFNKMNARNIAMVFAPNMTHMADPLTALMYAVQVMNFLKTLVVKTLRVREESIVKSNPVPNLNSFDDDGHQSDSQVLPKDGSENGNDCSDEDTVFVSAEPSQPSPTHHTEDGCETESGSETSPTPAENFLSSGSRLLIDSCPCNVVSQLCSFAIGLQDSSIATGQAKISRSKSLQMSTSDIDKSFKNVIEFPVVGPAEKNRGTAIIGRINSRTELTEAWR

SEQ ID NO: 19677 - protein, 410 aa, Zea mays
MRDGRVSFQLQHTGEIYISQGCNVTQTVFNGINVLAGVGLLSTPFTIHEAGWTGLAVLVCFAIVCCYTGILLKHCFESKDGISSYPDIGEAAFGRIGRLLISIILYTELYTYCVEFIILEGDNLTSIFPKAGFDWFGIHVDGKHFFGVLTAILVLPTVWLRDLRVLSYLSAGGVIATLLVFLSVGLVGATDGIGFHSTGKVVNWSGMPFAIGIYGFCYSGHSVFPNIYQSMSDRSKFPKALFICFAICTAIYGSFAVIGFLMFGENTLSQITLNLPKHSFASKVALWTTVINPFTKYALLLNPLARSLEELRPEGFLNETSCSIILRTALVASTVCIAFLLPFFGLVMALIGSLLSILVAVIMPALCFLKIAQNKATCAQVIASICIVMLGVISAALGTYSSVKKIVENY

SEQ ID NO: 19678 - protein, 302 aa, Synechococcus elongatus PCC 6301
MQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREGYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 19679 - protein, 346 aa, Lactobacillus johnsonii NCC 533
MKYAEFVKAGEMKIIDKPMPKIEKNDDVIIKVVRTCVCGSDLWAYNGVEEQGHENGGHEVIGIVQEIGKDITTVKKGNFVIAPFTHGCGHCRACLAGFDGVCMSHDLSENFSNGYQAEYVRFQHAQWSLVKIPGKPDDYTEGMLKSFLALADVMATGYHAARVADVQPGDSVIVLGDGAVGLSAIIAAKLRGAKQIVSTSRHADREALAREFGATENVAERDEEGIQNLLAITRSGADAVLECVGSKLSNEEALQVGRPGSRVGRVGLPHGAELNPGLIFYKNMSVAGGPASVTTYDKQVLLTAVLDGRINPGKVFTKTFTLDQINEAYQEMADRKAIKSYIKVND

SEQ ID NO: 19680 - protein, 334 aa, Zea mays
  misc_feature (97)..(97): Xaa can be any naturally occurring amino acid
  unsure (1)..(334): unsure at all Xaa locations
MYVKYHDLHGGKQESRKSNYTDLANKYYDLVTGFYEYGWGDSFHLAGGYPGETSREAIKRHQHFLALQLGLKKGMKVLDVGCGIGGPLIEIARFRQXSAIISTSITGLNNNDYHISRGKELIFSAGLSEQCCFLKGDFMDMPISDNTFDAAYAIQATCHAPDAQGVYSEVYRVLKPGQYFALDEWCLTDRFDPNNAKHLAIKAEIELGDGLPDIRTTRQCVQAMKDAGFEVVFAKDLAQVFPCPWYRVMDPTYFSWAHFQCTRPGRIVTRAIVNTLEFLRIAPAGSMGAYNVLMSASDGLLKGGREGIFTATFFVLGRKPLKEVDIVSLSRKLI

SEQ ID NO: 19681 - protein, 469 aa, Photorhabdus luminescens subsp. laumondii TTO1
MKKTKIVCTIGPKTESEEKLAELLNAGMNVMRLNFSHGDYEEHGQRIQNIHSVMTKTGKQAAILLDTKGPEIRTMKLEGGNDVSLTAGQTFTFTTDTSVIGNKDRVAVTYRGFPADLAPGNTVLVDDGLIGMTVKEVTKSEVICQVLNNGDLGENKGVNLPGISISLPALAEKDKQDLIFGCQQGVDFVAASFIRKRSDVLEIREHLKAHGGENIQIISKIENQEGLNNFDEILEASDGIMVARGDLGVEIPVEEVIFAQKMMIQKCNIARKVVITATQMLDSMIKNPRPTRAEAGDVANAILDGTDAVMLSGESAKGKYPIEAVTIMATICERTDRVMPSRIEAVHCRNLRVTEAVCRGAVETAEKLEAPLIVVATYGGKSAKSIRKYFPDAPILALTTNEVTARQLLLVKGVFTQIVKEIASTDDFYRIGKEAALASGLAKKGEIVVMVSGALVPSGTTNTSSVHVL

SEQ ID NO: 19682 - protein, 491 aa, Silicibacter sp. TM1040
MSLSALSARAEISDKALVRSFSYINGKWCASSNGEVVAVHDPATGDFIGDVTAMTAEDSSAAVDAAHAAFTSWALMLPQDRCALLRRWFELMIEHKEDLARLMVLEQGKPLSEARGEIDYGAAFVEFYAEESKRPNIEGVTSHLPDAEVELWREPVGVAALITPWNFPSAMLTRKAAAALAAGCTVVAHPSAETPFSALALAELAERAGIPKGVFNVITGKAPVVVEPWTRDARVRALSFTGSTEVGKLLYRQSAETVKRLVMELGGHAPVIVFKNCDLDRAVAETIKAKFATSGQDCLGANRIFVERDIYDEFCTRFVAATQALSVGKGIDDPDIGPLMNEKAVQKQEEHVADALEKGATLACGGKRHALGPLFYEPTVLTDVPADALILHEETFGPVAPITPFDSEDEVIQRANDSEYGLVAYVHSHDPRRIYRLSRALQFGMVAVNRTKVTGAPIPFGGTKQSGMGREGARLGMEEFTEVKYVCRDWA

SEQ ID NO: 19683 - protein, 307 aa, Desulfovibrio vulgaris subsp. vulgaris str. Hildenborough
MSTHTPPSSATPTSGQGVRPLTTADIRKAKGRQRLAMLTAYDYTSARIVDGAGADLILVGDSLGMVMLGREDTLSVTLDEMLHHCRAVVRGTRHAMVVADMPFMTYETGVRDALLNGARLFRESGVRAVKLEGAGPVLPQVRALVDAGIPVMGHLGLTPQRVAEMGGFKVQGRQAEAALRLFDDALALQEAGCFSLVLECVPAPVAEQVTARLHIPTIGIGAGAGCDGQVLVLHDMLGLYGELSPRFVKRYADLAGMAGEAVARYAHEVREGSFPAAEHTFGIDDGQFEAFMAALDKRGCRQTPTGE

SEQ ID NO: 19684 - protein, 345 aa, Blastopirellula marina DSM 3645
MKAMLLSEYKQLDVVEFAEPEIGADDLLIQVKACGICGSDIHGYDGSTGRRIPPLVMGHEAAGVVAKVGSAVTDYQVGDPVTFDSTVSCGVCFYCRQGHINLCDNRMVLGVSCGEYRRHGAFAEFVSVPQHICYRLPADFPYEHAAMIEAVSVAVHAANRAPLVLGDTAIVVGSGMIGLLVVQAIRLAGAAQVIAIDLDEGRLELAKKLGADVGLKADAVDVAAEVKKRTGGRGADVAIEVVGATRTIQTAIDSTRKGGSVTLVGNVSPQVEMPLQAIVSRELTVYGSCASNGEYPACIDLLQRGLIKVDPLITAKISLDQAPEWFARLYQGEPGAMKVIVDPTL

SEQ ID NO: 19685 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLQHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 19686 - protein, 140 aa, Rhodovulum sulfidophilum
MAIQRTFSIIKPDATKRNLTGAINAKLEAAGLRIVAQKRIHLSKAQAAVFYAVHKERPFYDELCEFMASEPIVVQVLEGEDAIAKNREVMGATNPAEAAEGTIRKEFALSIGENSVHGSDAEDTAKEEIAYFFSGLELVG

SEQ ID NO: 19687 - protein, 510 aa, Solanum tuberosum
MANIDIAGIMKDLPNDGRIPKTKIVCTLGPSSRTVPMLEKLLRAGMNVARFNFSHGTHEYHQETLDNLKIAMQNTQILCAVMLDTKGPEIRTGFLTDGKPIQLKEGQEITVSTDYTIKGNEEMISMSYKKLVVDLKPGNTILCADGTITLTVLSCDPPSGTVRCRCENSATLGERKNVNLPGVVVDLPTLTEKDKEDILEWGVPNNIDMIALSFVRKGSDLVNVRKALGPHAKRIQLMSKVENQEGVINFDEILRETDSFMVARGDLGMEIPVEKIFLAQKMMIYKCNLAGKAVVTATQMLESMIKSPRPTRAEATDVANAVLDGTDCVMLSGESAAGAYPELAVKIMSRICIEAESSLDNEAIFKEMIRCTPLPMSPLESLASSAVRTANKARAKLIVVLTRGGSTAKLVAKYRPAVPILSVVVPVLTTDSFDWSISDETPARHSLVYRGLIPLLGEGSAKATDSESTEVILEAALKSAVTRGLCKPGDAVVALHRIGSASVIKICVLK

SEQ ID NO: 19688 - protein, 114 aa, Rhodopirellula baltica SH 1
MSNDSALPLEITVSDLDAMRTRGDEFVLLDVRETAEYETARIEGSKLLPMSEIQQRLSELDEHRQDHIVVQCHHGGRSMQVTQFLQSQGFEKVQNLAGGIDQWSQQIDSSVPRY

SEQ ID NO: 19689 - protein, 148 aa, Helianthus annuus
MEQTFIMIKPDGVQRGLVGEIIGRFEKKGFTLKGLKLLTVDQAFAEKHYADLSAKPFFNGLVEYIISGPVVAMVWEGKNVVTTGRKIIGATNPAESPPGTIRGDFAIDIGRNVIHGSDAVESAKKEIGLWFPEGVANWSSSLHPWIYE

SEQ ID NO: 19690 - protein, 157 aa, Zea mays
MQASRARLFKEYKEVQREKSADPDIQLICDDSNIFKWTALIKGPSETPYEGGVFQLAFAIPEQYPLLPPQVRFLTKTFHPNVHFKTGEICLDILKNAWSPIWTLQSVCRAIIALMAHPEPDSPLNCDSGNLLRSGDIRGYQSMARMYTRLAAMPKKG

SEQ ID NO: 19691 - protein, 149 aa, Saccharum officinarum
MESTFIMIKPDGVQRGLIGEIISRFEKKGFYLKALKLVNVERSFAEKHYADLSSKPFFQGLVDYIISGPVVAMVWEGKSVVTTGRKIIGATNPLVSEPGTIRGDFAVDIGRNVIHGSDSIESANKEIALWFPEGLADWQSSQHPWIYEK

SEQ ID NO: 19692 - protein, 255 aa, Brassica napus
GDIHGQYQDLLRLFEYGGYPPSANFLFLGDYVDRGKQSLETICLLLAYKIRYPSKIYLLRGNHEDAKINRIYGFYDECKRRFNVRLWKIFTDCFNCLPVAALIDDKILCMHGGLSPELDNLNSIREIQRPTEIPDSGLLCDLLWSDPDQKIEGWADSDRGISCTFGADKVAEFLDKNDLDLICRGHQVVEDGYEFFAKRRLVTIFSAPNYGGEFDNAGALLSVDESLVCSFEIMKPALASSSGHPLKKVPKMGKS

SEQ ID NO: 19693 - protein, 408 aa, Agaricus bisporus
MRSAIVLGVLVSVAAAIALQSPVGRTSLLDRSASISSGCSTSGPTSCHNTSPVSDTCCFESPGGLLLQTQFWDTDPSTGPIDSWTIHGLWPDKCDGTFDQNCDPSRAYTGISSLLTSQGASDTLSFMNTHWVDINGQNERFWEHEWEAHGTCMSTLETSCLPSGSPRGAEAVAFFETVVRLFKTLPTYDWLSDAGITPSTSRTFSRSTLSSALENVAGVTPSLGCNGNTLNAISWYFNLKGSIIDGEFIPINAIESGSCPSSGIRYPPKSGSGTPTSTSPPGPTGNPGSLPTKATIHAIHSGSELGGLLSLGTWSTQTLATFTISGSADSFTMKSSKGDCGLSGGMFKCGSGVSSTTFSAKSSDGSLLLASGGSTSFSSDGIPSGTTVFDVYMGSSHGQQYTLEIIGS

SEQ ID NO: 19694 - protein, 399 aa, Rickettsia akari str. Hartford
MSIISTRLNSIKPSPTLAVVKKTLELKKSGIDIIALGAGEPDFDTPDNIKEAAIKAIQDGFTKYTNVEGMPLLKQAIKDKFKRENSIDYELDEIIVSTGGKQVIYNLFMASLDKGHEVIIPAPYWVSYPDIVALSTGTPVFVNCGIEHNFKLSAEALERSITDKTKWLIINSPSNPTGASYNFEELENIAKVLRKYPHVNVMSDDIYEHIIFDDFKFYTLAQIAPDLKERIFTVNGVSKAYSMTGWRIGYGVGSKTLIKAMTIIQSQSTSNPCSISQMAAIEALNGPQDYIKPNALNFQKKRDFALSILKRVKYFECYKPEGAFYLFVKCDKILGHKTRSGKIISNSNDFAEYLLEEAKVAVVPGIAFGLEGYFRISYSTSMEEIEEACMRIERACNAL

SEQ ID NO: 19695 - protein, 424 aa, Synechococcus elongatus PCC 6301
MPSRRQRIYHDPLHGAIALQFEDPLEATLIRLIDTPPFQRLRRTCQLGPASLTFHGAEASRFTHSLGVMQVARRAFAPIAADWPELAVHRPALLCAALLHDLGHTAFSHTGEEIFHCQHEQWTARLITEDSPIRRVLADYDPALPEQVLAVYRKQYQPLLISRLITSQLDCDRLDYLLRDSYFTGASYGRLDLDRILSALRFDSESGELAVAEKGLAAIEHYLVVRSFMYSQVYNHPKNIVAGWMLVRIFERARQLWQEQPRSLFVDPLLQPWFEQPVTDLSLEEYLAVDDIVCLYHLQRWQDSADPLLADLCRRYRDRDLLKALNLRNLPAEQQQTLLEHSQQLIRNQGQDPTGYTGLCQTQSRGYTLYQSGIRLATDQGLLEISQRSPLIRALLEPPSQAWLIYPRVIEQPLKQQWQLVRGS

SEQ ID NO: 19696 - protein, 238 aa, Panax ginseng
MRAIYIISVIIVSLSIFSWGGNARSDYPWAMFALRLQWPAGFCEVNNACDTKSLLNTFTIHGLYPYNAKGTPALYCDGTAFDVNSVSDFLAEMHLAWPSHETNTEDIQFWEHEWKKHGRCSEALLKQTDYFRTALAFRKAFDIVGLLNQEGIYPNNDLYRPKMIKEAIKKHLNAVPEIDFTKNENSEYVLTDINVCVNQQATRFVDCPTDDATDDYRLKFVRLPSKMKFADPRTNSII

SEQ ID NO: 19697 - protein, 526 aa, Burkholderia vietnamiensis G4
MRRPWMPARSTFVSFMSAIPNSDPPGSPANPPTLHRALKARHLTMIAIGGSIGTGLFVASGASISQAGPGGAMVAYMLIGLMVYFLMTSLGEMAAFMPVSGSFATYGAKYVDEGFGFALGWNYWYNWAVTIAVELVAAQLVMHYWFPDVPGVWWSAAFLAVMFLLNALTVRGFGEAEYWFALIKVVTVLAFIGVGLLMIFGILKGAPANGWGNLTIGDAPFAGGLPALMGVAMIAGFSFQGTELIGVAAGESEHPRTTIPRAVRQVFWRILLFYVLAIFVIGVLIPYTDPNLLKSDVTDIGVSPFTLVFRHAGLAFAAGVMNAVILTAVLSAGNSGMYASTRMLYNLATEGRAPKLFAKLSPGGVPRNALYATTAVGALCFFTSLYGDKTVYLWLLNTSGMTGFIAWLGIAISHYRFRKGYVTQGYSIDQLPYQSKWFPFGPLFAFVLCMVIALGQDYQAFLANRIDWAGVAATYVGIPLFVVVWLGYRLMNRSRFVRYEDMEIAPWIAANRGGAAPRVENRETAG

SEQ ID NO: 19698 - protein, 364 aa, Arabidopsis thaliana
  misc_feature (288)..(288): Xaa can be any naturally occurring amino acid
  misc_feature (294)..(294): Xaa can be any naturally occurring amino acid
  misc_feature (296)..(296): Xaa can be any naturally occurring amino acid
  misc_feature (300)..(301): Xaa can be any naturally occurring amino acid
  unsure (1)..(364): unsure at all Xaa locations
MTLRCMQALVRVQSRVLDQRKRLSHDGSRKSAFSDSHAVFESRYLQDLSDRQSMSREGSSAAEDWDDRPHTIDAVKVMLQRRRDTALRHDKTNLSQAFSQKMWRTVGNQSTEGHHEVELEEERPKWLDRWMATRPWDKRASSRASVDQRVSVKTVEIDTSQPYSRTGAGSPSRGQRPSSPSRTSHHYQSRNNFSATPSPAKSRPILIRSASPRCQRDPREDRDRAAYSYTSNTPSLRSNYSFTARSGCSISTTMVNNASLLPNYMASTESAKARIRSHSAPRQRPSTXERDRAXLXKKRXXYPVPPPAEYEDNNSLRSPSFKSVAGSHFGGMLEQQSNYSSCCTESNGVEISPASTSDFRNWLR

SEQ ID NO: 19699 - protein, 116 aa, Glycine max
  misc_feature (34)..(34): Xaa can be any naturally occurring amino acid
  misc_feature (82)..(82): Xaa can be any naturally occurring amino acid
  misc_feature (111)..(111): Xaa can be any naturally occurring amino acid
  unsure (1)..(116): unsure at all Xaa locations
KIYCPNVSTVNHAGAGMVAPFTGLKSMADFPTRXTNNDITSIASNGGRVQCMHVWPPDGKNKVDTLPYLPDLDDAQLANEGXYLHTKGWIPSLEYELEHGNVYPEHNMSPXYYDGR

SEQ ID NO: 19700 - protein, 153 aa, Spinacia oleracea
AEFERTFIAIKPDGVQRGLISEIVARFERKGFSLVAIKVVIPSRPFAQKHYADLKDKPFYVGLVAYWSSGPVVAMVWEGEGVIKYGRKLIGATDPQKSEPGTIRGDLAVVNGRNIIHGSDGPETAKDEIKLWFKPEELVNYTHNAEKWIYGDN

SEQ ID NO: 19701 - protein, 430 aa, Magnetospirillum magnetotacticum MS-1
MDLHHPELTYAAIVALAAVLCGGLMTRLKQPAIVGYILAGVVLGPSGFGLVSNRDAVATLAEFGVLMLLFVIGMKLDIIRFLEVWKTAVFTTVLQIAGSIGTALLLRHGLGWSLGLAVVLGCAVAVSSTAVVIKVLESSGELETPVGRTTLGILIAQDMAVVPMMLVLESFETKVLLPADLARVILSVLFLVLLFWWLSKRRIDLPLTSRLSRDSDLATLSSLAWCFGTAAISGVLDLSPAYGAFLGGVVLGNSAQRDMLLKRAQPIGSVLLMVFFLSIGLLLDFKFIWKNLGTVLTLLAMVTLFKTALNVAALRLARQDWPSAFLAGVALAQIGEFSFLLADTGKAVKLISAQETKLVVAVTVLSLVLSPFWLFTMRRMHRVAAVHVHSFRELVSRLYGDEARTARRARTLVRRGSWRDDHNAGPGTGI

SEQ ID NO: 19702 - protein, 613 aa, Coccidioides immitis RS
MAPITFSDPVRPGAGAARDSLELASLASSESRNQTSRSSSPSGISSSRRVSLENQDPLSDSPYDITRQRHARSYSVSSAFDFGSNLFPLSQTVGGYAPLGAPSASSLEHHVGLVDGSLEKRKTLTYLNGLSLIIGLIIGSGIFSSPGRVSTNTGSPGASLIIWAVAGVLAWTGAASYAELGGAIPLNGGAQVYLAKIFGELAGFLFAWCAVFVLKPGSAAIIAIIFGEYVVRAIVGADADMISPWINKGVALLGIVFVTFMNCISTRLGTRIGDLFMFFKFVALLGVTITGIIVACTGLSYDGKPNMDWKTTGWFEGTNKDISSWAVALYAGLWAFDGWDNTNYVTGEFKHANRDLPRVIHTAMPLVILCYILANVAYFFVLPSSTIAATNTVAVQFGGKVFGPIGALIIALVVSGSCIGALNATTFTSGRLVYAAGREGYLPSIFSKIGIGGSASPTGGRLRTRSWFHKLLIRLLGDDIGIGYTPIYAMIFNSTLCVCYVAVGEFGTLVTFYGVAGYTFYFLTVLGLIVLRIREPHLERPYKTWIATPIIFCCLLSLQPVFRYISGEYPSEMGKANWQGGGGSSGGDGGGSEGGKPPFASIYHRSNVFKQVG

SEQ ID NO: 19703 - protein, 370 aa, Saccharophagus degradans 2-40
MELNTTEEIIDEIRQGRMVILMDDEDRENEGDLIMAAEQVRPEDINFMATHARGLICLTLSEERCKQLDLPLMVRDNHAAHSTNFTVSIEAAEGVTTGISAADRARTIRAAVKRDALPRDLVQPGHIFPLMSQPGGVLSRAGHTEAGCDLARLGGYEPAAVIVEIMNEDGSMARREDLEKFAKLHNIKIGTIADLIQYRAINEKTVTCINERTVHTNHGEFILKTYLDKARKECHFALLKGEVRPDEPTLVRVHVGNTARDVLGVQRTDMDNLSWSFQDAMKRVAEEGNGVLVLICHNETTEEIEESIDWMLSGKKARPRQDVAYKQVGTGSQILKDLGVSKMRLLSAPFKFKAISGFNLEVVEYLKNDA

SEQ ID NO: 19704 - protein, 148 aa, Thermoplasma acidophilum
MTERTLVLLKPDAVKRRLIGRIISRLEDKGLKVVALKFMQMTKDQAENHYSVHRSKPFFKDLVTYITSGPIVAMVLEGPKAIEVVRILAGSTDGSKAQPGTIRGDFSMGIEKNIIHASDSPEAYSHEMPIFFNESEIVEWSYGDEIIY

SEQ ID NO: 19705 - protein, 147 aa, Listeria innocua
MEQTYVMVKPDGVERGLIGEIVAKIEKKGIKLVAGKLMQIDRTLAEQHYAEHIGKPFFEDLIGFITSGPVFAMVLEGDDVIKTARRMMGKTNPLEADPGTIRAEYAIHTNRNVIHGSDSPESAKREIQLFFEPHEILSYEKAVDTWI

SEQ ID NO: 19706 - protein, 552 aa, Leptospira interrogans serovar Lai str. 56601
MNPNMKLSKKYTFRSRKVLLIILDGVGYSPKGPESGNAIAGAKLPFLNRVWNQFPTLHIQAHGKAVGMPSDDDMGNSEVGHNVLGSGRIFDQGAKLVSNSIASGDIFNGQAWKEVIGNSKKNNSTLHLLGLFSDGNVHSHIDHTKALISQAILEKVPKIRLHILLDGRDVPEKSALDYLNPFETWLDSLRKSGTDIRIASGGGRMTITMDRYEADWSMVERGWKVHVKGEGRYFSSAKEAIETFRSENPKIIDQYLPSFVISDNGKPVGKIQDGDSVVFTNFRGDRAIEISLAFTEKNFDKFDRGPLPNVLYAGIMQYDGDLKLPERFLVAPPAIDRTLGEYMASSNIPQYALSETQKYGHVTYFWNGNKSGYFDQNSEEYREILSDVIPFDQSPEMKALLITEALEKALNENKQDFYRVNYANGDMVGHTGNYLATVQAMEFLDGCVERLWKTCEKQNIVLLVTADHGNADEMFQLDKKGNVEKDSHGNPIPKTSHTLNPVPISILDPENKIRFNSKLSNPGLANVAATILDVMGYETPEGYHPSLIQNES

SEQ ID NO: 19707 - protein, 388 aa, Legionella pneumophila str. Lens
MNQCEKKNLPKDSATVAINSLAQQKINAGIKIHNLSAGEPKLPPHPSIINAVTQAMEQGHTLYPPIMGIPELRHLGCEWMHRSYDCSFQNEQCLVVNGGKLGIYLLMQLLLQPNDEVIIPSPYWVSYPAMVSLFGGTPVPVETTEAEEWKLTPQALQKACTTKSKILILNNATNPTGALYTQSELIHLLQTAKKHNLLVISDEVYSELTYDGHHYVSCGSLPQFRESVIIIQSCSKNFSMTGWRVGFIFAPEVFIKPLSALVSQSTSGVTTLSQWAAVAALQEVNQVNIWVQQNMEKRRNCLLRTLHDYLGLTITPPISSLYVFLSLKDIGCKNQNSEEFCKQVLDKANVAMVPGIAFGKEGYVRLSFGGNEDDLKSGIYALAQWLHR

SEQ ID NO: 19708 - protein, 430 aa, Corynebacterium diphtheriae
MTSTQRSQELFARAQQFTPGGVNSPVRAFGSVGGHARFIQSAKGSKLYDVDGNEYVDLVCSWGPMLLGNAHPEIVEAVQKAATNGLSFGAPTEAEVKIAEMIVDRTSVEEVRMVNSGTEATMSAVRLARGFTGRPKVIKFDGCYHGHVDALLASAGSGVATFALPDSPGVTGASAADTIVVPYNDSEAVRAAFEAHPDQIACVIAEAAAGNMGTVAPQDNFNAKLKEVAHEHGALLILDEVMTGFRTSYNGWYGVDGVAGDLTTFGKVISGGLPAAAFGGRADIMRYLAPEGPVYQAGTLSGNPVAMAAGMKSLELATPEVYDMVRANADRLAGLLHEALDREGVAHHIQRAATMLSVRFAEGEGHNFDDMKAADTFRFPAFFHALLDNGIYASPSVFETWFVSAALTDDDFDKIEKALRPAAQAAGKAK

SEQ ID NO: 19709 - protein, 527 aa, Zea mays
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASSTLLPINFDGLAKALTPGATIFVGQYLFTGSETTSVWLEVSEVKGDDVVCIIKNTATLAGSLFTLHCSQIHIDLPTLSDEDKDVIKKWGAPNKIDFLSLSYTRHAEDVRQAREFLSKLGDLSQTQIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYYKRTVKYVGEPMTHLESIASSAVRAAIKVKASVIICFTSSGRAARLIAKYRPSMPVLSVVIPRLKTNQLKWSFTGAFEARQSLIVRGLFPMLADPRHPAESTSATNESVLKVALDHGKASGVIKSHDRVVVCQKVGDSSVVKIIELDD

SEQ ID NO: 19710 - protein, 292 aa, Triticum aestivum
  misc_feature (192)..(192): Xaa can be any naturally occurring amino acid
  unsure (1)..(292): unsure at all Xaa locations
LRENNINLGKVYNIIGIFFGSVEKVPFTKRTLRNICGKISREQAEDELRKTLQVFADIWSSDPGFSYVVLAEKDSKVKNLMWANGSRRMQYRFFGDVVTFDTTYRTNLYDMPLCLFVGVNNHYQSIILAGVLMCDEQEESFEWVFSEFIRMMGGPAPKTILTDQCRAMEVAIKKIHPNTVHRLCKWHVLKRXKETLGWLYTKKCDFQAEFHKVVNHMLTEEEFESAWDALLDKYNLRGHNYMTQIYETRHKWAKPYFRGVFCAKMTSTQRSESANHMLKTDMPPASPMHVFV

SEQ ID NO: 19711 - protein, 182 aa, Arabidopsis thaliana
  misc_feature (116)..(116): Xaa can be any naturally occurring amino acid
  misc_feature (147)..(147): Xaa can be any naturally occurring amino acid
  misc_feature (153)..(153): Xaa can be any naturally occurring amino acid
  unsure (1)..(182): unsure at all Xaa locations
MVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGRYWTMWXKLPLFGCTDSAQVLKEVEECKKEYPMPSIRXIGFGNXRQVQWIRFIAKSTKFTGNSLCFGNPSPLC

SEQ ID NO: 19712 - protein, 835 aa, Oryza sativa
MASSSPLCCYLLLFVVVVVLTGSCRARDTVVPGRPLAANETLVSGGDANFVLGFFTRPGANSTYVGVWYNKVSVRTVVWVANREDPLPGDVADNPDATLSVSPTGTLAIVAGNSTVVWSVTPAAKLASPTARIMDSGNLVIADGAGGGVAWQGFDYPTDTLLPEMRLGVDYVKGRNRTLTAWKSPSDPSPGPVVMAMDTSGDPQVFIWNGAEKVWRSGPWDGVQFTGVPDTVTYSGFTFSFINNAKEVTYSFQVHNVSIISRLGLNSTGSYGLLQRSTWVEAAGTWNLYWYAPKDQCDEVSPCGANGVCDTNNLPVCSCLRGFTPKSPEAWALRDGRAGCVRSTPLDCQNGTDGFVAVEHAKVPDTERSVVDLGLSLEQCRKACLMNCSCTAYASANVSGGGRGHGAGTGCVMWTTGLTDLRVYPEFGQDLFVRLAAADLGLTSKSNKARVIIAIVVSISSVTFLSVLAGFLVWTRKKKRARKTGSSKWSGGSRSTGRRYEGSSHHDDDLELPIFDLGTIAAATDGFSINNKLGEGGFGPVYKGKLEDGQEIAVKTLSKTSVQGLDEFKNEVMLIAKLQHRNLVRLLGFSISGQERILVYEYMANKSLDYFLFARYRIIEGITRGLLYLHQDSRYRIIHRDLKASNVLLDKEMTPKISDFGMARMFGSEETEINTRKVVGTYGYMSPEYAMDGVFSVKSDVFSFGVLLLEIISGRRNRGVYSYSNHLNLLGHAWSLWNEGKSLELADETMNGSFDSDEVLKCIRVGLLCVQENPDDRPLMSQVLLMLATTDATTLPTPKQPGFAARRILMETDTSSSKPDCSIFDSATVTILEGR

SEQ ID NO: 19713 - protein, 541 aa, Treponema denticola ATCC 35405
MEWWNKRVFYQIYPRSFCDANNDGMGDIQGIISKLPYLKELGIGAIWLSPVTASSDYDNGYDVSDYCDINPKFGTMDDFKSLLKEADKLDIKIVMDLVINHTSDQHRWFIESKNPESPYHNYYVWKEPRLVKGKKLPPNNWDSLFLGSAWKYCEENGLYYLHLFTENQPDLNYNNPAVTEEVKKILKFWLDMGVAGFRCDVINCIYKTSYEDAKKRRIKTGKEFYLSQKGCHDILKELNRDVLKPYNAFTVGETMDVSLEEAKDFIQDELTLVFPFEHHTGVDCWFQIPVLKRKYKPFRMIKILKKWQTKMPWTPLFFENHDQARSVSRFGDEGKYYKESVKMLATVLLTQKGTPFIYQGQEIGLTNTDFKSMDEIDDIATKNIYDTLRRLKFGKKRAFKMTMNYARDHARTPIPWDDSENGGFCTVKPWLRLNEKYKEINVKKNLSESDSCFNYYKKLIALRNEEEVLQLGDIEFADLGKDIFAYYRKKGDKTFFIVSNMSGKAQKIREEVRGLPILFNYRNFNPQQKILRPFESVITRI

SEQ ID NO: 19714 - protein, 331 aa, Zea mays
GNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFN

SEQ ID NO: 19715 - protein, 227 aa, Malus x domestica
MGITGITYVVTMVFSLIVLILSSYTAGYDYFQFTQQYQPAVCNSNPTPCKDPPDKLFTVHGLWPSNSTGRDPKYCNPSNVTSHMLKNIQAQLEIIWPNVLNRTDHIGFWERQWKKHGSCGRPAITNEVDYFQTVIKMYITQKQNVSKILSKAKIEPEGRIRMLKDIEDAIRNGTNNKKPKLKCQKNSRMTELVEVTLCRDSNLTQFINCPSPILPGSPFLCPANIRY

SEQ ID NO: 19716 - protein, 637 aa, Senecio squalidus
MKTGQNFTLTSWLSNDIPDSGSFTLSWEPVDEASQRLIIRRSHQPYWTSGNLNDQTFQYLYALNSPGSQSHYNLSSVYSNEARYFSYERTNADLPMWILTPKGQLRDSDNSTVWTPEFCYGYESSNGCVESSLPQCRREGDNFSEKNGDFAPDIARSATDDNSSLSISDCFVKCWNDCSCVGFNSSTTDGTGCVIWTGSNNFLVNPRDNSTLKYVISQSPINPSAGNKTEESKTKESKTWIWILLGVVIPLALLCFGLLLYTKIKHRRKEYERRKRDEYFLELTASESFKDVHQLESNGGKGNDLLLFSFSSIMAATNDFSVENKLGQGGFGPVYKGKLSDGREIAIKRLSRTSGQGLVEFKNELILIAKLQHTNLVRVLGCCIHGEEKMLIYEYMPNKSLDFFLFDENRKAELDWPKRFNIIEGIAQGLLYLHKYSRMRVIHRDLKANNILLDENLNPKISDFGMARIFKENETEAMTNRVVGTYGYMSPEYAMEGTFSIKSDIFSFGVLMLEIVTGRKNTSFVHLDRTFNLIGYAWELWQQGDTLELKDPTLGETCGIQQFLRSVHVALLCVQESATDRPTTSDMISMLLNDTISLPTPNKPAFVIGKVESKSTDESKEKDCSVNDMTVTVMEGR

SEQ ID NO: 19717 - protein, 421 aa, Chlamydophila abortus S26/3
MVIKFDDDARASCFVPVEKAIADIAEGKFVIVVDETSRENEGDLIIAGEKMTVEKMTFLLKYTTGIICASLDSERIKQLDLPPMVKDNRCRYRTAFTVSVDAAKGITTGVSAADRTRVVELLSDPNSVPGDFVRPGHFFPLMATPGGVLKRAGHTEAALDLMRLANMQPCGVLSELVNEDHTMMRLPQIIEFAMQHKLSIISTSDLVAYRMLSERLVVPISSARLPTEYGDFTIHVYESVLDGIQHIALVKGDVRGKENVLVRVHSECLTGDILGSIRCDCGCQLHSAMEYIGLEGEGVLVYLRGQEGRGIGLGHKVRAYALQDRGYDTVDANLEIGFPIDSREYGIGAQILVDLGLTKIKLITHNPHKYFGLQGYGLEIVDRIALPINLSEENECYLRTKKERMGHWIDFPSYKEEVNIR

SEQ ID NO: 19718 - protein, 190 aa, Chlamydophila abortus S26/3
MKVIYYEIAETPSTNATAKQFMHVWNPFALTVVSTQKQTDGKGKFNKSWVSSNKDLTLSFCFFITELDIDVSLLFRLGTEAVLELIQDLGITNGTIKWPNDVLVHGEKLCGVLSETLPSQGYLGIVLGIGINGNSSQEDLASIEQPATSLSILLQHPIDLEEIRHRLVEHVRKCILQRFSKILAREMNHG

SEQ ID NO: 19719 - protein, 330 aa, Candida albicans SC5314
MSNNIEDDSISVDNIVDRLLEVRGSRPGKQVTLTENEIRFLCTKAREIFIQQPILLELEAPIKICGDIHGQYYDLLRLFEYGGFPPEANYLFLGDYVDRGKQSLETICLLLAYKIKYPENFFILRGNHECASINRIYGFYDECKRRFNIKLWKTFTDCFNCLPIAAIIDEKIFTMHGGLSPDLNSMEQIRRVMRPTDIPDVGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPADKKPRYAPANVANNRPGANQRKPKKAVK

SEQ ID NO: 19720 - protein, 216 aa, Oryza sativa (japonica cultivar-group)
MLKKLLSKPKSKKKKEAASSALPTLDRLHETLEMLEKKECFLQKKASAEVERAKDYTKAKNKSAAIQCLKKKKLYETQIEQLANFQLRVHDQIIMLESAKATTDTVDALRSGSSAVKAIHQSVSIDDIENAIEEANEHTENMRQIQEALATPIGASADFDEDELEAELEDLEEEELENDLPEPPQRTSMEPSARVTTTQPANDLAELTKLQAEMAL

SEQ ID NO: 19721 - protein, 367 aa, Prunus persica
MGKGGMSSQGGALEAHVEQENMAAWLVGVNTLRIQPFKLPTVGPNDVRVKIKAVGICGSDVHYLKTMKCADFVVQEPMVIGHECAGIVDEVGSLVKNLVPGDRVALEPGISCWRCEQCKGGRYNLCPDMKFFATPPVHGSLANQIVHPADLCFKLPENVSLEEGAMCEPLSVGVHACRRANIGPETNVLVIGAGPIGLVSVLSARAFGAARIVIVDVDDERLSIAKSLGADDAVKVSTNPQDLEDEVSKISKAMKGGVDVSFDCVGFNKTMSTALSATRPGGKVCLVGMGHGVMTVPLTPAAAREVDVVGIFRYKNTWPLCLEFLRTGKIDVKPLITHRFGFSQKEIEEAFETSARGGNAIKVMFNL

SEQ ID NO: 19722 - protein, 235 aa, Saccharomyces cerevisiae
DGAHIGNYQIVAKVKLAYHTTTGQKVALKIINAAAMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSPNYAAPEVISGPEVDVWSCGVILYVMLCRRLPFDDESIPVLFKNISNGVYTLPKFLSPGAAGLIKRMLIVNPLNRISIHEIMQDDWFKVDLPEYLL

SEQ ID NO: 19723 - protein, 801 aa, Oryza sativa
MDDTPTSSGKSEVNSCEPSWWPPDFLAKIESVSLSRKQSVFSDKEPRSNLRSSSWKASQLLWSTGTYSGFIPNGFYSIIPDKKLKENFPTIPSLDDLQTLEADGLKADIIIVDVERDKKLFMLKQLSGALVKGLNSSPALVIKKIAGLVFDCFKSLDPDVSPARSPTEDNHFFGNKGSQLLGQIKHGSCRPRAILFKVLADAVGLESKLVVGLPDDGGVGFVDSYKHMSVVVSLNSMELLVDLMRFPGQLIPFSAKAIFISHISAAGESDSAENDSCDSPLEPNSPLYGLSDKVEAEGIEASSNLSGRSLRNVMLRSRTFSEGKLSTSCSEPNIANAFWRRSQRRGVAEEPRGASSSPEHPLMKTRARSILGGEQHSFQEYAESGVTSRSDGLGGASTSKTRRIRGRSISITPEIGDDIVRAVRAMNETLKQNRLQRDHVNEGSPSYVGEDQNNASDCPNNDDTSGGVVATNNGPRNRNGSTQKAMSLPSSPHEYRAQISETINPCDFVSKEKMVLAWNKVLQSSPFLNKPLLPFEEWNIDFSELTIGTRVGIGFFGEVFRGIWNGTDVAIKVFLEQDLTTENMEDFCNEIYILSRLRHPNVILFLGACMVPPHLSMVTEYMEMGSPYYLIHMSGQKKKLSWRRRLKIVRDICRGLMCIHRMKIVHRDLKSANCLVNKHWTVKICDFGLSRVMTDSPMTDNSSAGTPEWMAPELIRNEPFTEKCDIFSLGVIMWELCTLSRPWDGISPVQVVYTVANEGSRLEIPEGPLGKLIADCWAEPQDRPSCQEILTRLLDCEYAVS

SEQ ID NO: 19724 - protein, 239 aa, Saccharomyces cerevisiae
DGAHIGNYAAAAKVKLAYHTTTGQKVALKIINAAMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLL

SEQ ID NO: 19725 - protein, 574 aa, Frankia sp. CcI3
MDSEPLSEPIGDHTPGPAPAMPVGGTLRDPHWFKRAVFYEVLIRGFADSNGDGTGDIRGLISRLDYLEWLGVDCLWLLPIYSSPLRDGGYDISDYFQILPEFGDLGDFVSLVDEAHRRGIRIIADLVMNHTSDAHPWFQASRSDPDGPFGDFYVWSDSDELYPDARIIFVDTEKSNWSWDPVRGQYYWHRFFSHQPDLNYDNPEVQEAMLEVLRFWLDLGIDGFRLDAVPYLYVRENTNGENLPETHEYLKRVRKEVDAKYADRVLLAEANQWPSDVVEYFGNDDECHMAFHFPLMPRIFMAVRRESRYPISEILAQTPQIPPNCQWGIFLRNHDELTLEMVTDEERDYMWAEYAKDPRMKANIGIRRRLAPLLDNSRDQMELFTALLLSLPGSPVLYYGDEIGMGDNIYLGDRDSVRTPMQWSPDRNAGFSTADPARLYLPLIMDPVYGYQALNVEAGQRMPTSFLAWTKRMIEVRKRHPVFGLGDYTELGASNPSIFAFVREFGDDRVLCVANLSRFAQPVELDLRRFEGMVPVELLGRVHFPPIGELPYLLTLPGHGHYWFAVTRPGEFTP

SEQ ID NO: 19726 - protein, 120 aa, Francisella tularensis subsp. holarctica
MSEINQLGKVYERPWGTYQTINFTDKSQTKIITVKPQGQLSLQKHFKRAEHWVVVTGRPTITVDDNVREYNVGEHIFIPKEAVHRLENFTDSDIQIIEVQVGDYLGEDDIVRLEDIYKRS

SEQ ID NO: 19727 - protein, 226 aa, Malus x domestica
MGTGMIYMVMMVFSLILLILPSSTVGFDYYQFTQQYQPAVCNSNPTPCKDPTDKLFTVHGLWPSNSNGNDPKYCNAQQYQTMKILEPQLVIIWPNVLNRNDHEGFWRKQWEKHGSCASSPIQNQKHYFDTVIKMYTTQKQNISEILSKANIKPGRKNRTLVDIENAIRNVINNMTPQFKCQKNTRTSLTELVEVGLCSDSNLTQFINCPRPFPRGSRYFCPTNIQY

SEQ ID NO: 19728 - protein, 251 aa, Pseudomonas fluorescens Pf-5
MRRPMVAGNWKMHGTRASVAELINGLRHLALPSGVDVAVFPPCLYINQVIDGLKGKSIQVGAQNSAVESMQGALTGEIAPSQLVDAGCSLVLVGHSERRLIMGERDATLNRKFAAAQACGLKPVLCVGETLEQREAGKTLEVVGRQLGSIIEELGVGAFANAVIAYEPVWAIGTGLTATPQQAQDVHAAIRAQLAAENSEVARGVRLLYGGSVKAANAVELFGMPDIDGGLIGGASLNADEFGAICRAAGN

SEQ ID NO: 19729 - protein, 227 aa, Chlamydophila abortus S26/3
MAFLILLRHGKSVWNEKNLFTGWVDIPLSQKGIDEAMLAGEAIKDLPIDCIFTSSLVRSLMTALLAMTHHNSKKIPYIVHDDPEQKHMSKIYSDEVNHMIPLYRSSALNERMYGELQGKNKKKTAEQFGEEQVKLWRRSYKTAPPNGESLYDTGQRTIPYFQETIFPLLQNSKNVFVSAHGNSLRSLIMDIEKLSEEEVHSLELPTGKPIVYLWTGHTFERHPELFG

SEQ ID NO: 19730 - protein, 142 aa, Brassica napus
MATSLASLPTSFCLNHVDECCKRSPTKPSLSSYHPAAKRSLMGHSLRCHEFSSTARRFVVMAATGGSRKSKESQPSWANPDSDEPPPWARDEGGSSSSTSQESFEVPFFVYLLASAITAIAAIGSVFEYSSRNPVFGVLESD

SEQ ID NO: 19731 - protein, 506 aa, Photobacterium sp. SKA34
MGFLIAGFALKSFGFTSTPTLETLANLGVTLLLFTIGLKLDVKSLLKKEVWGGATLHNLLSTALFTLCLLVLKQLGLTMFSDMALSQLILIGFALSFSSTVFAIKLLQEKGELNAKYGTVSIGILVMQDIFAVIFLTISSGKMPEVYALGLFALPLLRPILYKILDKAGHGEVLVLYAITLALVLGAGLFKLVGMKPDLGALLIGMLMAGHSKSSEMAKSLFNFKELLLVCFFLNIGLSETPTLNGLLMAFVLLLLLPLKGMLYYGIFHLCRYRVRTSMLATLTLFNYSEFGLIVGGVAYKLGLLPGTFLVAIAIAVSFSFLLAAPLNSMSHKLYTEASKWLKEFEPEKLNADDKLIDLGQSKVLILGMGRIGTGAYDELQARYGKQIIGVESREESAEQQRKEGRNVIQGDATDPDFWARVISKERITLILLAMPHSQANVYALEQIKTRHFQGKIAAIAQYNDDEELLYEQGIDAVFNIFNEAGSGFARNVCDHLKPDITAIKS

SEQ ID NO: 19732 - protein, 555 aa, Aspergillus nidulans FGSC A4
MAEPEKTELEALEVVRERAQDADAFIDEMEQKLEATGGLETGFFQIQFKDPKHFTWLLVAFASMGGLLSGIDQSTISGANLYLPKDLHLDARQNSLVNSGMPLGAVGGALILSPCNEYLGRKWSIIISLILYTIGAALEAGSINYGMMVAARVILGVGVGLEGGTVPVYVAETVERRIRGNLVSLYQFNIALGEVLGYAISAMFLRVPGNWRYILGSSLVFSTIMFVGMLFLPESPRFLVHQGKTLDAYKVWKRIRGIQTVEARDEFFVMTASVRQEENEVHEGAHNKRFPWMDFFTVPRARRSLIYANIMIILGQMTGINAIMYYMSVLMNQIGFNEENANYMSLVGGGSLLLGTIPAIFLMESFGRRFWAIVTLPGFFIGLVLIGASYQVDLKTDLMTVEALYLTGLIVYQGFFGCYACLTWVVPSEVYPTYLRSYGMTTSDALLFLMSFIVTYNFTAMQEAMGKTGLSLGFYGGIAAVGWVYQVFFMPETKDKTLEEIEEVFSRPTMDIVRENWAGVKETCGNLARGNFRKVFAEQTKRRRSVHETELKGLA

SEQ ID NO: 19733 - protein, 264 aa, Pseudomonas putida KT2440
MKTIYMVGAGHMGGAILLGLKAYFKSATDLRVIEIDTQRSNDWRAKGFETSSRIQTLQPQDCVVLAVPPQQFENMLAANPVLCRHRGPVVSVMAGITHATLVRLLGHDAVVRAIPNTPSEVAQGVTMYYAPSDADAALIDSARQIFDVIGLSLRVNDERQIDTGTALAGGGPALVAHFADALQDYGLHMGLDSEQAAVVALQLLSGTAALIQASGKPASQICQEVQTAGGTTERAIRALDAAGFKGLVNAALDAAARRSAELGQ

SEQ ID NO: 19734 - protein, 457 aa, Triticum aestivum
  misc_feature (410)..(411): Xaa can be any naturally occurring amino acid
  misc_feature (420)..(420): Xaa can be any naturally occurring amino acid
  misc_feature (424)..(424): Xaa can be any naturally occurring amino acid
  unsure (1)..(457): unsure at all Xaa locations
VTLQNKFVQKSRLRTGPEFPGYRRPTRPSSGDVCGVLVQYPGTEGEVLDYAEFVKDAHAHGVKVVMATDLLALTTLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPAGLKAIADRVHGLAGTFAHGLKKLGTVTVQELPYFDTVKITCADANAIAEEARKNEMNLRVVDANTITVAFDETTTLEDVDKLFKVFSGGKPVDFTAESIAPEVSSSIPPSLVRDSPYLTHPIFSMYHTEHELLRYLHKLQSKDLSLCHSMIPLGSCTMKLNATVEMMPVTDPKFANMHPFAPIDQAAGYHEMFDNLGDLLNTITGFDSFSLQPNAGASGEYAGLMVIRAYHKAXXGTTNRNVLXSIPXVSAQGTKPCKLLLCVGMKNWFPVWNWIQVTINN

SEQ ID NO: 19735 - protein, 305 aa, Bacillus subtilis
MRSTLRKDLIELFSQAGNEFISGQKISDALGCSRTAVWKHIEELRKEGYEVEAVRRKGYRLIKKPGKLSESEIRFGLKTEVMGQHLIYHDVLSSTQKTAHELANNNAPEGTLEGNGVWMSLILRPDIPLQKTPQLTLLAAVAVVQGIEEAAGIQTDIKWPNDILINGKKTVGILTEMQAEEDRVRSVIIGIGINVNQQPNDFPDELKDIATSLSQAAGEKIDRAGVIQHILLCFEKRYRDYMTHGFTPIKLLWESYALGIGTNMRARTLNGTFYGKALGIDDEGVLLLETNEGIKKIYSADIELG

SEQ ID NO: 19736 - protein, 592 aa, Neisseria meningitidis MC58
MTVLKLSHWRVLAELADGLPQHVSQLARMADMKPQQLNGFWQQMPAHIRGLLRQHDGYWRLVRPLAVFDAEGLRELGERSGFQTALKHECASSNDEILELARIAPDKAHKTICVTHLQSKGRGRQGRKWSHRLGECLMFSFGWVFDRPQYELGSLSPVAAVACRRALSRLGLDVQIKWPNDLVVGRDKLGGILIETVRTGGKTVAVVGIGINFVLPKEVENAASVQSLFQTASRRGNADAAVLLETLLVELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKADGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIYGLLNMIAAEGREYEHI

SEQ ID NO: 19737 - protein, 508 aa, Zea mays
MHGPRVAVVTGGNRGIGLEICRQLASNGVLVVLTARDEKKGSRAVEELQSAGLSDVVFHRLDVADRPSIAQLAEFVKRRFGKLDILGFSRSHVWVVQVNNAGVAGTTIDPERLKDLQKQDPKAGFRAIIFGWFLTFCQHTHTQKKKEQCLSSADKEDLKTFVDGYMGSLQQSYELAKDSLEINFNGTKHVTDCLIPLLLLSKSGRVVNVSSQVAQLKFMSNEGAIKVLSDIDNLSEAKLDEVMSAFMEDFKDGNLAARGWLPVVSAYAVSKALVNAHSRLLARRHPSLVVCCVTPGFVRTGMNYGMGLVSAEEGAAAPVALALRAEPADSGLNFELLDKKKNLTNFNASLKLRCVQNRKCSDGSTYNGQTFIQLLTDKDSSHGKYGRGTQPITLLFGASATNLRRRRGRPSPSIFEDAVELLGSCYWNLDDAISLYLSNAGGSTKPPSDSPADPSLLRRTCRRKRTRTKTTAMQSTATVKTTRALLGTTAVAVPPSRTPASWGRRHLQ

SEQ ID NO: 19738 - protein, 528 aa, Arabidopsis thaliana
MVIGAAARVAIGGCRKLISSHTSLLLVSSQCRQMSMDAQSVSEKLRSSGLLRTQGLIGGKWLDSYDNKTIKVNNPATGEIIADVACMGTKETNDAIASSYEAFTSWSRLTAGERSKVLRRWYDLLIAHKEELGQLITLEQGKPLKEAIGEVAYGASFIEYYAEEAKRVYGDIIPPNLSDRRLLVLKQPVGVVGAITPWNFPLAMITRKVGPALASGCTVVVKPSELTPLTALAAAELALQAGVPPGALNVVMGNAPEIGDALLTSPQVRKITFTGSTAVGKKLMAAAAPTVKKVSLELGGNAPSIVFDDADLDVAVKGTLAAKFRNSGQTCVCANRVLVQDGIYDKFAEAFSEAVQKLEVGDGFRDGTTQGPLINDAAVQKVETFVQDAVSKGAKIIIGGKRHSLGMTFYEPTVIRDVSDNMIMSKEEIFGPVAPLIRFKTEEDAIRIANDTIAGLAAYIFTNSVQRSWRVFEALEYGLVGVNEGLISTEVAPFGGVKQSGLGREGSKYGMDEYLEIKYVCLGDMNRH

SEQ ID NO: 19739 - protein, 181 aa, Brassica napus
MASSMLSSAAVATSPAQATMVAPFTGLKSSAAFPVTRKSNTDITSIANNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 19740 - protein, 917 aa, Zea mays
MGGENMSTTGAGDDILPVTSVHKPAEGVSVTPPAALRAPGHIEEHTKTADVVGAEKHIPMRHIGPHEQDTPHILQSHPDNIDIRLIPKVGMTFSNVDEAYNFYSQYAYEVGFPLKKYRERKNCKWLNCSMEGKNAERVAGNPRIRNTCSKRTQCKAGMKLKKIYDDAKEKVISVRIDLVNYEHNHEFLKKDTEKGQLQCNKTHDREYMEFLSAMQESRIPPHCIMDFVTEMHGGPENVPITVQDMSNLKKAWQRERNANDVSKLLSFFSLCKKDNPQFFSDFQLDKEGKILSIFWSHASQQVEYIDFGDAVTFDTTHKTNMYDKPLGMFVGSNHHLQCTIFGFALLGDETVDTFEWVFNTFKTCMGCDGPRVMLTDQDPAMPIALGRVFPNTIHRLCLWHVQNRYMPHLNELYARFEDMDFKTRFQSIIHHPLNEMEFEAAWQMMLDDFQLHENNTLARLYEIRKDWVPAFFKGDYCGLMVSTQRSESMNKLVKSAHVDANTPLHEFAKQMMKLLHSRKMKEAKEALGCMGQKDTTTLYMFEIRVARADTRAVMTRFQETVKYATAYRIDRDTEGEEHDWVVKHTTRSNKIVWGQHQFKIRADVDAGKYSCECKHWEHTGLFCVHLVRAFMHLQIERIPSEYILQRYTYSAHQDVAFSRDDRNLKGKDGETRSYRQKMLLKKAMKVVHHASLSKAGNDKALEMMDELLGLLMRVEPDIGTGESCGTSVCDDIQVEAYETEEMAIDNLRKLDDGNEEILMGSNTNECNTKDDQCNMQILTLEHNTDIQLVESSSMDVEARKKLEFHMEGVNLAIPDKAEPKGRTIKSSEQQVLKLGVKGAKKMSRKCQKCGIADGHNSRTCLTVEDNRVRLANLSRRKRGRPPGSRNKIIAAAPQWNETSTSKKRTVDVGDDDSSGRE

SEQ ID NO: 19741 - protein, 304 aa, delta proteobacterium MLMS-1
MKVLISDNLAPVGEKIMRDAGLEVDVRTGLSPEELVKIIPAYDGLVIRSASKVTAEILEAAENLKVVGRAGIGLDNVDVPAASKKGVVVMNAPDGNATTAAEHAVSMMMALTRNIPQATASMKAGKWEKKKFQGHEVTAKVAGVVGIGRIGRIFAERAMGLRMKVIAFDPHMPAEQMEKIGVEPVTLEELCQRADYISVHVPLTPETKHVLGAEQFAMMKPTTMVVDCARGGVVDEKALYEALKTKTIRGAALDVFEVEPTTLENCPLLGLDNFICTPHLGASTAEAQENVRGGHRRTASPTIY

SEQ ID NO: 19742 - protein, 94 aa, Triticum aestivum
MSAKYAFTKSLREVRFLFCQTSEQSAALRSFITRSYPTMKRNNPNIPILIREAAGTQPKIFARYERGVEKSQILEGLSDKEIEDTVTSLVQPAQ

SEQ ID NO: 19743 - protein, 475 aa, Oryza sativa
  misc_feature (436)..(436): Xaa can be any naturally occurring amino acid
  unsure (1)..(475): unsure at all Xaa locations
MAQQLSAPFRAAAAAGSRASAAAADPAKVSPSLPFLLCSLSLTFFPTPPPEFSGLFRVGVRLAEGWDVFVRCVTSCVADTAPRFRLKLGFRESGNLGLGGGGANAGVRFLFIARNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKAASEGALKGILGYTDEDVVSNDFVGDARSSIFDAKAXGIGLSSSFMKLVSWYDNEWGYSNRVLDLIAHMALVNAKH

SEQ ID NO: 19744 - protein, 175 aa, Triticum aestivum
MAPTVMASSATSVVPFQGLKSTVGLPVSRRSNGASLGSVSNGGRIRCLQVWPIEGIKKFETLSYLPPISREALLKQVDYLIRSKWVPCLEYSKVGFIFREHNASPGYYDGRYWTMWKLPMFGCTDATQVINEVEEVTKEYPDAYVRIIGFDNMRQVQCVSFIAFKPPGCEESGKA

SEQ ID NO: 19745 - protein, 227 aa, Haemophilus somnus 2336
MELVFIRHGFSEWNAKNLFTGWRDVNLTERGIEEAKAAGKKLLEAGYEFDIAFTSVLTRAIKTCNIVLEESNQLWIPQVKHWRLNERHYGALQGLDKKATAEQYGDEQVHIWRRSYDVSPPDLDPQDPNSAHNDRRYALLPKDVVPNAENLKITLERVLPFWEDQIAPALLSGKRVLVTAHGNSLRALAKHIIGISDEEIMAFEIPTGQPLVLKLDEQLNFVEKFYL

SEQ ID NO: 19746 - protein, 322 aa, Thermosynechococcus elongatus BP-1
MSDQPRPTVIITGASSGVGLYATKALANRGWHVIMACRNLEKAEQAAKNLQIPPEAYTILHLDLSSLASVRGFVESFRALNRPLRALVCNAAVYYPLLKEPIYSVDGYEITVATNHLGHFLLINLLLEDLKNSPESDKRLVILGTVTANRKELGGKIPIPAPPDLGNLEGFEKGFKKPIAMINGKPFKSGKAYKDSKLCNMLTARELHRRFHESTGIVFNSLYPGCVADTPLFRHHFPLFQKLFPLFQKKITGGYVSQELAGERVAMVVADPEFRQSGVHWSWGNRQKEGRKAFVQELSAEASDEQKARRLWELSEKLVGLA

SEQ ID NO: 19747 - protein, 337 aa, Oryza sativa (japonica cultivar-group)
MAKIKIGINGFGRIGRLVARVALQSDDVELVAVNDPFITTDYMTYMFKYDTVHGQWKHHEVKVKDSKTLLFGEKEVTVFGCRNPEEIPWGETGAEFVVESTGVFTDKDKAAAHLKGGAKKVVISAPSKDAPMFVVGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMAFRVPTVDVSVVDLTVRLEKPASYDQIKAAIKEESEGKLKGILGYVEEDLVSTDFQGDNRSSIFDAKAGIALNDNFVKLVSWYDNEWGYSSRVVDLIRHMYNTQ

SEQ ID NO: 19748 - protein, 464 aa, Zea mays
MASPRCWSVVCPKPRQVASESVHGAQLALQRLSRRCETCDGEASTPCSCRKEAVARDTEEDSSGPNSSFAHSVINMVGMLIGLGQLSTPYALENGGWASVFLLIGLGVMCAYTAHIIGRCLDEDSAGSKTYQDIGKRAFGVKGRVIASTFTYLEIFLALVSYTISLSDNLPLVFAGVHLHLPWLHLSATQLLTIIAVLLALPSLWLRDLSSISFLSFAGIIMSLLIFGSVVCAAAFGRVSLGKHIPVLQLEKIPAVSGLYMFSYAGHIVFPNIYAAMKDTSSFTKVSVTSFAVVTALYVALAFVGSSLFGAAVNSQITLSMPPHLVVTKVALWATVLTPVTKYALEFAPFAIQLQHHLPEGMGPRARMFVRGGVGSAALLVILALALCVPYFQYVLSLTGSLVSVAISVIFPCAFYLKIYWGRVPMSTVTINVVLILTGVVLAVVGTISSAMSLVQSIQRGHAA

SEQ ID NO: 19749 - protein, 291 aa, Lactobacillus johnsonii NCC 533
MTEVPTITLNDGNKMPLLGLGVFQIPDHEKARQTVEMALANGYRMIDTAEVYENQIAVGEAIAESAVNRDDIFLTTKIWVSNMSFEKATKAIDHDLKELGTDYLDLVLLHQPYGDTFGAWNALAAAKRAGKVRSIGLSNFYPDQYMNLELAHEDKPAINQIEINPWFQQTNDVKFFQGRDVVVEAWAQFAEGKHDIFNNKTLKEIADAHHKTTAQVILRWLTQQDIVVIPKSVHEKRQKENLDIFDFELTKDEMDKIKGLDKGVSQFFDHRDPAVIDDIFGESLKQLRDSE

SEQ ID NO: 19750 - protein, 58 aa, Brassica napus
MFACQERTSESLNVDGCKNITDASLVAVAMNCYSFNDLDASNTLVSDQKVKALASSSN

SEQ ID NO: 19751 - protein, 399 aa, Rickettsia prowazekii
MSIISTRLNSIKPSPTLAVVKKTLELKKAGVNIIALGAGEPDFDTPDNIKEVAITSIKDGFTKYTNVDGIPLLKQAIKNKFKRENNIDYELDEIIVSTGGKQVIYNLFMASLDKGDEVIIPVPYWVSYPDMVALSTGTPVFVNCGIENNFKLSVEALEHSITDKTKWLIINSPSNPTGAGYNCKELENIAKTLRKYPNVNIMSDDIYEHITFDDFKFYTLAQIAPDLKERIFTVNGVSKAYSMTGWRIGYGAGSKALIKAMTIIQSQSTSNPCSISQMAAIEALNGTQDYIKSNALNFQKKRDLALSILEEVTYFECYKPEGAFYLFVKCDKIFGTKTKSGRIIANSNNFSEYLLEEAKVAVVPGIAFGLDGYFRISYATSMQELEEACIRIKHACNAL

SEQ ID NO: 19752 - protein, 466 aa, Yersinia pestis biovar Medievalis str. 91001
MMSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKVTK

SEQ ID NO: 19753 - protein, 501 aa, Wolbachia endosymbiont strain TRS of Brugia malayi
MNFKSVVLCILDGWGNGIGDSKYNAISNANPPCWQYISSNYPRCSLSACGTDVGLPDGQIGNSEVGHMNICSGRVVMQSLQRIDREIKTIENNKNLRSFISDLKDKNGVCHIMGLVSDGGVHSHQKHISTLANKISQHEIKVVIHAFLDGRDTLPNSGKKCVQEFEENIKGNDIRIATVSGRYYAMDRDNRWERTIETYEAIAFARATCHNNVMSLIDNNYQNNITDEFIRPTVIGDYKGIELKDGVLLANFRADRMIQLASILLGKTGYTEVAKFSSILSMMKYKEDLQIPCLFPPAFFTNTLGEIIADNKLRQLRIAETEKYAHVTFFFNCGKEEPFSNEERILIPSPKVETYDLQPEMSAFELTEKLVGKIRSQEFTLIVANYANPDMVGHTGNMEAAKKAVLAVDDCLAKVLNTVKEINDAVLIVTADHGNVECMFDEKNNTPHTAHTLNKVPFIIYPNSCNNLKLKDGRLSDIAPTILQLLGIKKPDEMTGSSLIV

SEQ ID NO: 19754 - protein, 911 aa, Arabidopsis thaliana
MEDYGFEYSDEEQEEQDVDIENQYYNSKGMVETEPEEALSGFAEVVQMEPEKADWGFKALKQTVKIYYRLGKYKEMMEAYTEMLTYIKSAVTRNYSEKCINNIMDFVSGSASQNTGLLQEFYQTTLKALEEAKNERLWFKTNLKLCNIWFDIGEYRRMTKILKELHKSCQKEDGTDDQKKGSQLLEVYAIEIQIYTETKDNKKLKQLYHKALAIKSAIPHPRIMGIIRECGGKMHMAERQWEEAATDFFEAFKNYDEAGNQRRIQCLKYLVLANMLMESEVNPFDGQEAKPYKNDPEILAMTNLIAAYQRNEIIEFERILKSNRRTIMDDPFIRNYMEDLLKKVRTQVLLKLIKPYTKIGIPFISKELNVPETDVTELLVSLILDSRIDGHIDEMNRYLLRGDSGNGRKLHKAVDKWNSQLKSLSSNITSRQLDSNCKRWVICTGTLTNNVDVFFEEMNRRQQVKRRVGKYEVGRTIGEGTFAKVKFARNSETGEPVALKILDKEKVLKHKMAEQIRREIATMKLIKHPNVVQLYEVMASKTKIFIILEYVTGGELFDKIVNDGRMKEDEARRYFQQLIHAVDYCHSRGMVGLKHGILIEKLPMHILCAPENLLLDSYGNLKISDFGLSALSQQVRDDGLLHTSCGTPNYVAPEVLNDRGYDGATADMWSCGVVLYVLLAGYLPFDDSNLMNLYKKISSGEFNCPPWLSLGAMKLITRILDPNPMTRVTPQEVFEDEWFKKDYKPPVFEERDDSNMDDIDAVFKDSEEHLVTEKREEQPAAINAFEIISMSRGLNLENLFDPEQEFKRETRITLRGGANEIIEKIEEAAKPLGFDVQKKNYKMRLENVKAGRKGNLNVATEIFQVAPSLHMVQVSKSKGDTLEFHKFYKKLSNSLEQVVWTNNEVKKETAK

SEQ ID NO: 19755 - protein, 608 aa, Zea mays
  misc_feature (178)..(178): Xaa can be any naturally occurring amino acid
  unsure (1)..(608): unsure at all Xaa locations
MTLGDSPSWRFMLGVLSVPSLAYLALTVLYLPESPRWLVSKGRMKEARAILQMLRGREDVSGEMALLVEGLGSSDDTVIEEYVLGPAAAGDESEHETRDQVTLYGPEQGLSWVAQQVQGARSSVLGSAVGLASRQGSMYEQMKDPVVTLLGSVHDKMPDSGASARASTLFPNLGACSXTERHGGDWDEENVPPNDDLDDDEDEEEYLSDDEDAGAGAAARGGGGGGGALHAPLLSRQSTDVDVTSGTSKKDGSHPPESSPMQRYSSITSGEAASTMGIGGGWQFGTRWTEMVGADGVRRGGVKRMYLHEEGGGDGDSSDPAGGYVHAAALVSPSILYTKDVLIGQSPTPAFDSPPPETVANKAGGGPCWRELLEPGVRRALFCGVMIQILQQLSGINGVMYYTPQILDQAGVSVLLSSLGLSADSASILLSGVTMLMMLPCIVVAMRLMDVAGRRSLLLRTIPVLIVSLAVLVLANVVPMAAKVHALLSTACVVVYFCCFVMGFGPIPNILCAEIFPTRVRGICIAVCSLTFWICDIIVTNSLPVMLRTIGLAGVFGSYAFVCCLSLVFVYLRVPETKGFPLEVIIEFFNVGAKAQKPEQHEEEENHD

SEQ ID NO: 19756 - protein, 256 aa, Botrytis allii
AYMLKYDSTHGQFKGDIKVLSDGLEVNGKKVKFYTERDPANIPWAESEAYYVVESTGVFTTTEKAKAHLKGGAKKVVISAPSADAPMYVMGVNNETYKGDVDVISNASCTTNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKGASYDEIKAVIKKAADGPLKGILGYTEDDVVSTDMNGDNHSSIFDAKA

SEQ ID NO: 19757 - protein, 338 aa, Blumeria graminis f. sp. hordei
MAPIKVGINGFGRIGRIVFRNAAQSCEVEVVAVNDPFIEPEYAAYMLKYDSTHGQFNGDIQTVEDGLVVNSRNVKFYNKRNPEEIPWAETGAEYIVESTGVFTTTEKAKAHLKGGAKKVIISAPSADAPMFVMGVNHKSYTTDLEVISNASCTTNCLAPLAKVINDEFTIIEGLMTTIHSYTATQKTVDGPSAKDWRGGRTAAQNIIPSSTGAAKAVGKVIPALNGKLTGMAMRVPTANVSVVDLTCRIEKSATYDEIKKAIKIAAGNELQGILSYTEDEIVSTDLIGNNHSSIFDAKAGISLNDNFVKLVAWYDNEWAYSRRVIDLISYIAGKDGSK

SEQ ID NO: 19758 - protein, 179 aa, Glycine max
LFSAEQLKDLGCKWVVLGHSERRHIIGENDEFIGKKAAYALSQGLGVIACIGELLEEREAGKTFDVCFQQLKAYADAVPSWDNIVIAYEPVWAIGTGKVATPQQAQEVHVAVRDWLKKNVPDEVASKTRIIYGGSVNGGNSAELAKQEDIDGFLVGGASLKGPEFATIVNSVTSKKVAA

SEQ ID NO: 19759 - protein, 296 aa, Gloeobacter violaceus PCC 7421
MAHAATRTFEVPVNIYRPASPFRGKALQNINLTPDDPDNDVRHVVLDLSGGDLRYFEGQSIGIVPPGTDAQGKPHKLRLYSIASSRIGDNKDGKTVSLCVKRVVYKHPETGEIVRGVASNFICDLAPGDDVSITGPTGKTFLLPEDPSTNLVLIATGTGIAPFRAFLRRIYDEMDTPWQGKVWLFFGMQNSNSYLYQDELAGYTAKGDFEIVEAISREQKNAQGGRMYVQHRIAEHAAALWELISGGNTYTYICGLKGMEDGIDDAFTAAAAAKDTVWKDYRYNLKQSGFWHVETY

SEQ ID NO: 19760 - protein, 392 aa, Alkalilimnicola ehrlichei MLHE-1
MDIKLANRVQRVKPSPTLAVTAKAAELRAAGKDIIGLGAGEPDFDTPEHIRDAAITAINEGETRYTPVDGTPALKKAVINKFKRENGLDYDGKQVLVSSGAKHSLYNLMCALLNEGDEVIIPAPYWVSYPDMAKLADAEPVIIEAGQEQGFKITPEQLEGAITDRTRLFVINSPSNPTGSAYSKAELAALGEVLKKHPQIVVVTDDIYEHILFEGEFVNIVNACPELKDRTVVVNGVSKAYAMTGWRVGYAAGPEALIGAMKKIQSQSTSNPASVSQAASVAALDGDQGCIPPMLEQFKKRHDFVVDALNKIDGVECRPCEGTFYCFPNMQGAIDKLDGVGNDVELAGFLLEQGVALVPGSAFGLEGYARISFATSMENLEKAMERIAKALG

SEQ ID NO: 19761 - protein, 341 aa, Solanum tuberosum
MEYDGILLGMGNPLLDISAVVDQDFLNKYEIKPNNAILAEDKHLPMYDEMAAKPTVEYIAGGATQNSIRVAQWMLQFPGATSYMGSVGKDKFGEEMKKNAQDAGVNVHYYEDETAPTGTCAVCVLDGERSLVANLSAANCYKVDHLKRPENWALVEKAKFYYIAGFFLTVSPESIQLVAEHAAANNKIFSMNLSAPFICEFFRDPQEKALPYMDFVFGNETEARIFSKVHGWETDNVEEIALKISQWPKASGTHKRITVITQGADPVVVAEDGKVKLFPVIPLPKEKLVDTNGAGDAFVGGFLSQLVQEKPIAECVRAGCYASNVIIQRSGCTYPEKTDFA

SEQ ID NO: 19762 - protein, 178 aa, Zea mays
MASSMISSPAVTTVNRAGAGMVAPFTGLKSMAGFPTRKTNNDITSIASNGGRVQCMQVWPPIGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 19763 - protein, 356 aa, Clostridium perfringens SM101
MLYSLILAGGKGTRLYPLSRSSNPKQFLSIHNNGKSFLSNTVDRIRPIIHKDNIYVVTNQEYEDKIRDELKDIREENIFTEPANKETATCIGLSAAKLLKKDKDAVMIVLPSDHYIEGDKSYLQTLEQAVEIADKKRAIVTIGIEPTRPETGYGYIEMGDRVNGHIPTFKIARFTEKPNLEVAKDFLLKGTYLWNSGMFIFRADVILREIEKYIPKMYKCLMEIYQHIGEDDEEEIIKEQYSLIDGISIDFGVMQKTRRSFVIKCDFSWDDIGTFSALSRFLGPNGNNRTSDNVFLEECENCSVFGKEKLIIGFGIKDLVLVDAGDVILVMDKGRDQEIKHLLNSISGKKEFKEYL

SEQ ID NO: 19764 - protein, 99 aa, Vigna radiata
MARSFTNVKVLSALVADGFSNTTTRHGFAAAAAATQSATRGGASIGGNMVPKSGEEKVRGGEKVSWVPDPVTGYYRPENTNEIDVADMRATVLGKKFNQ

SEQ ID NO: 19765 - protein, 401 aa, Bifidobacterium longum DJO10A
MAQWQTLSDRINTVAPSATLAVDSKAKAMKAAGLDVVGFGAGEPNFPTPANVVKAAADACLDPKNYKYTPTPGLPELREAIAAKMLRDSGYEVNADQVVVTNGGKQAVYESFQILLNDGDEVIIPAPYWTSYPEAVKLAGGVPVEVFAGADMNFEPSLEALEAARTEHTKAIIVNSPNNPTGAVWKPETVEAIGRWAVEHHIWVISDEIYEHLNYDDAHTTYIGAAVPECRGQLLVLNGVAKTYAMPGWRVGWMVAPLEVAKAAAKLQGHMTSNVANISQRAALAAVAGPLDEVHEMRKAFDARRRAIVTALNDIEGVNCPTPTGAFYAFADITALLGKPLGPKGTVSDTSADFAAALLDEAHVAAVPGEAFGAPGYLRFSYALADEDLAEGMRRFKEWAN

SEQ ID NO: 19766 - protein, 179 aa, Triticum aestivum
  misc_feature (111)..(111): Xaa can be any naturally occurring amino acid
  unsure (1)..(179): unsure at all Xaa locations
YVTEIVLAACYKALNDQHVLLEGTLLKPNMVTPGSDAKKVAPEVIAEYTVRTLQRTVPAAVPAIVFLSGGQSEEEATLNLNAMNKSKTKNPGNLSFSFGRALQQETLKAWXSGKTENEEKPRRRSWVRCKPIRGTLGTTRATHLGRGALRLHSRINTIICFRGLGSLQYMVLSDNLVHC

SEQ ID NO: 19767 - protein, 261 aa, Wolbachia endosymbiont strain TRS of Brugia malayi
MKKFLLKPKKSLGQNFILSSEITKRIVVLAGNLEDFNVIEIGPGYGALTKEILAHNPKSLLAIEKDSNLVKCHDQLLNEHQGKFRIVEADALYVVEEELIERPVKVIANLPYNISLALFLKWLNKIKLFTTFTLMFQKEVADRIIARPNSKDYGSLSVLSQLLCDIRREFDIEPKEFFPRPKVYSSVITVKPLPTQRFAVNLEALTKLTRAVFAQRRKMLRNSLQNVTNRTETALENAKLSGNERPKNLTVEQFCLLANNM

SEQ ID NO: 19768 - protein, 233 aa, Wolbachia endosymbiont strain TRS of Brugia malayi
MSFLIVANWKMNGTRSLFVNFIGKLNDKSNEITSKLVICPPFTSLPGNIELNSNISIGAQNCHYKKSGSYTGEISAEMLKELGCTYVILGHSERTHETNGEIKLKSETAIESGLHPIICVGENLEDRESSKTKEVVEYQCKSRLPIHGEYTVAYEPIWAIGTGHVPSNNAIAEVIEVIQSYTSKKHVIYGGSVSLENIENLSNILNLSGVLIGSASLDFDRFHKIVQQVEKAY

SEQ ID NO: 19769 - protein, 237 aa, Oenococcus oeni PSU-1
MAKLVFIRHGQSEWNALNLFNGWVDTKLSEEGIRQAKEAGELLAEKGIQFDQAYTSVLTRAIQTLHIALEEIDQLWIPEEKSWRLNERHYGALQGLNKKASAEKWGDEQVHIWRRSYDTLPPLQDEIQKSITVNGKTYPALDRRYAELDPKTLPLGENLKVTLERVMPFWEDKIAPDLRAGKNVIIAAHGNSLRALSKYIENISDADIMGLEIANGQPIIYDFDENLKFTNKELLSK

SEQ ID NO: 19770 - protein, 270 aa, Streptococcus pneumoniae TIGR4
MISCVCACGKCYYCKKGIYAHCEDEGGWIFGHLIDGMQAEYLRVPHADNTLYHTPEDLSDEALVMLSDILPTGYEIGVLKGKVEPGCSVAIIGSGPVGLAALLTAQFYSPAKLIMVDLDDNRLETALSFGATHKVNSSDPEKAIKEIYDLTDGRGVDVAIEAVGIPATFDFCQKIIGVDGTVANCGVHGKPVEFDLDKLWIRNINVTTGLVSTNTTPQLLKALESHKIEPEKLVTHYFKLSEIEKAYEVFSKAADHHAIKVIIENDISEA

SEQ ID NO: 19771 - protein, 112 aa, Pseudotsuga menziesii var. menziesii
DVPEDIFHQSMGSFLQQSEEEISQIQVEEVKVFSHVKEITKYFHGNAVKEEAHPFRIFVVVRDFTSMLDRVCKEVGRLQKSRNPPISSQKGPSSTSDDKLSRSLFPTDFDRN

SEQ ID NO: 19772 - protein, 256 aa, Botrytis allii
AYMLKYDSTHGQFKGDIKVLSDGLEVNGKKVKFYTERDPANIPWAESEAYYVVESTGVFTTTEKAKAHLKGGAKKVVISAPSADAPMYVMGVNNETYKGDVDVISNASCTNNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKGASYDEIKAVIKKAADGPLKGILGYTEDDVVSTDMNGDNHSSIFDAKA

SEQ ID NO: 19773 - protein, 274 aa, Oryza sativa (japonica cultivar-group)
MCNGKGIRECVQCAGECVIWQESIDEQPWEKVRSSSPLKVKEDDEVDKLEIKINTSKRSRRTYPSPSPEVALKISRSLRSLNAKTGLFTKHMKIIHQDPKLHAQRVAAIKKTKGTAAARKHASETQKAFFSNPENRLKRSIAMKGVKFFCSKCGQEGHRSFYCPTVREISGRAHFRCRLCGGKGHNSRTCGKPKSENECQRQPRHCSQCGERGHNRRNCPRSTTVEVEVGASGYIVKQDNVHSSGIYSCSFCSAKGHNRRTCPKRKASIGQQKD

SEQ ID NO: 19774 - protein, 259 aa, Tropaeolum majus
MASAREESVYMAKLAEQAERYEEMVEFMEKVSASAEGEELTVEERNLLSVAYKNVIGARRASWRTISSIEQKEEGRGNEDHVTVIRDYRSKIESELSNICDGILKLLDTRLIPSASSGDSKVFYLKMKGDYHRYLAEFKTGAERKEAAESTLTAYKAAQDIANSELAPTHPIRLGLALNFSVFYYEILNSPDRACNLAKQAFDEAIAELDTLGEESYKDSTLIMQLLRDNLTLWTSDMQDDGADEIKEAAAPKPAEEQQ

SEQ ID NO: 19775 - protein, 112 aa, Pseudotsuga menziesii var. menziesii
DVPEDIFHQSMGSFLQQAEEEISQIQVEEVKVFSHVKEITKYFHGNAAKEEAHPFRIFVVVRDFTSMLDRVCKEVGRLQKSRNPPISSQKGPSSTSDDKLSRSLFPTDFDRN

SEQ ID NO: 19776 - protein, 367 aa, Zea mays
TFAGHSEDVLDLSWSKSQYLLSSSMDKTVRLWHMSSTYCLKTFSHTDYVTCIQFNPVDDRYFISGSLDEKVRIWSIPKREIVDWVDLHEMVTAACYTPDGKGALVGSHKGSCHLYDTSDDMLCYKTQIDLQNKRRKSSQKKITGFQFVPGDSSMVIITSADSRIRVLDGFELVHRFKGFRNTSSQISACLAGNGRYIISASEDSRVYIWRNDDGSKPSKKKGIVSVTNTHEHFHCESVTVAVTWPFTSTTMTSLMNPRKQELERGSENGYSPQDLQTKLAKAQEMTDVEYRRTNITSYNSKHNSDRTSPAWPEELVTPPNQSLSATTCHANEGDQALNRSAWGLVIVTAGRGGQIRTFQNFGFPVRV

SEQ ID NO: 19777 - protein, 247 aa, Oryza sativa
IAGGRSRSRTSPRVRLVPLPGSNNESWCQGLDGLASRCAEYYKQGARFAKWRTVVSIPCGPSALAVKEAAWGLARYAAIAQDNGLVPIVEPEILLDGDHAIERTLEVAEKVWSEVFFYLAQNNVLFEGILLKPSMVTPGAEHKQKATPEAIAKHTLTMLRRRVPPAVPGIMFLSGGQSEVEATLNLNAMNREPNPWHVSFSYARALQNSVLQTWQGRPDNVQAAQNALVVRAKANCWIRWMIHGEAK

SEQ ID NO: 19778 - protein, 639 aa, Trichodesmium erythraeum IMS101
MNNFFGLDVKDLVELAKTLEEKAKSGEIKTSFEVQSGPMRNIPRHGNIPRGMGRSNYQAQTGQSSQDTNFTVQSPNKDSVTQNRAQEKTNSTTSSPETKLRPTLRDIGGMSEVIQELREVIELPLKRPDLLTKLGLEPSRGVLLVGPPGTGKTLTAKAIAEELGLNYIAINGPEVMSKYYGEAEGKLRDIFAKAKKSAPCLIFIDEIDSIAPDRSKVEGEVEKRLVAQLLGLMDGFEVLEGVLLLAATNRPDHIDPALRRPGRFDQEVYFHVPDRDGRSEILQILTKAMPLDNSVDLEEIADLAVGLVGADLKAVCQKAAYFALRREVPSLENLNIQTPEDMSLLQSDLLRAIKEIKPSILRSVAVEVPNVSWQHIGGLDVVKQKLQESVEGALLYPELYEKTKAKAPKGILLWGEPGTGKTLLAKAVASQAQANFIAVNGPELLSKWVGAAEEAVRELFSKARQVSPCVIFIDEIDTLAPARGKTMGDSGVSDRLVGQLLTELDGLRDCTQLLLVGATNRPDALDPALLRAGRLDLQIKVDLPDQASRLEILKVHNQDRPLEEVNLEDWASRTEGWNGADLALLTNQAALAAIRSYSAQGIKSSKENDIKITSADFENAYNALKSQKQSNNFDSDICV

SEQ ID NO: 19779 - protein, 256 aa, Botryotinia calthae
AYMLKYDSTHGQFKGDIKVLADGLEVNGKKVKFYTERDPANIPWAESEAYYVVESTGVFTTTEKAKAHLKGGAKKVVISAPSADAPMYVMGVNNETYKGDVDVISNASCTTNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKGASYDEIKAVIKKAADGPLKGILAYTEDDVVSTDMNGDNHSSIFDAKA

SEQ ID NO: 19780 - protein, 234 aa, Staphylococcus aureus subsp. aureus MRSA252
MTKIVLITGGNKGLGYASAEALKALGYKVYIGSRNDVRGQQASQKLGVHYVQLDVTSDYSVKNAYNMIAEKEGRLDILINNAGISGQFSTPSKLTPRDVEEVYQTNVFGIVRMMNTFVPLLEKSEQPVVVNVSSGLGSFGMVTNPETAESKVNSLAYCSSKSAVTMLTLQYAKGLPNMQINAADPGATNTDLVGDFSNNSKHVSEGIKPIIQLATIDADGPTGTFINGNGEMPW

SEQ ID NO: 19781 - protein, 670 aa, Desulfovibrio desulfuricans G20
MELLGNLVLVLAFSVGVVLLAQKFRIPAMVGFLLAGVAAGPHALGMVSDVAAVDVLAEIGVVLLLFTLGMEFSIARLRALFRVALLGGGTQVAVTALAAGSVAHWLLGIAWNTSVFIGFLIALSSTAIGIRLMRDKGDVETPHGTAALGILIFQDMAVVPMMLLVPVLAGQEGSVAWALVTLTAKTALVVAGVLFLAVRGVPHLLHYVARWRNRELFLLTLLSICFGVAWGTHAAGLSLALGAFLAGLVISGSEYEHYAASQVLPLHDLFICFFFVSVGMSLDVGLALTNPLIVLTLTALLMLSKFVLVTGSALLPGLGFASAVMTGGMLCQVGEFSFILARLGNEAGLFSGEAMQLFLASAVVTMFLTPWAAGYAGRLGRFLRRRGSSALRDHTGVTSTAQSDHLVIIGYGPGGRHLAQAARLWNIDYVVIDSNPDTVRDERARGVPIMFGDAASETMLEHAGVERARAVAVVVSDPVAARTVTALVRELSPDVQIITRARYLGEYDGMREAGANDVVPAEMEASVAMVGRVLERFMVGSDELKAFLERIRAEGYQMDAEELEKRGKYSFLPFMQLRQVHVEEGSAVQGKTLGELHIRRKYRVAVMAVRHNGTVLPVPGAKTELLPGDEVLLSGCPGDIGIVASMFSKGGAPLPDENDTIPAGTACPVE

SEQ ID NO: 19782 - protein, 575 aa, Rickettsia rickettsii
MNNHILINVIILLGTAVFIVAILKRLRLSPVLGYLIAGAAIGDHGLKIVTYDQTKLLGELGVVFLLFAIGLELSFERLKAMRRYVFGLGSLQVLTTAIVIAGAMVLIDGNSSAAIITGGGLALSSTALVMQVIEENRSQSTQIGRVSLAILLLQDLAVVPLLVIVPLLAGNNKASLAAALGIALLKAVTALLTIFIVGRVFLRPVFSFISSESNNASELPISMTLLIVLSAAWATETFGLSLALGAFVAGVLVAETEFRLQAEESIYPFKSLFLGLFFMTVGMNIDALEMYEKISHILTLSIALIGIKTLIITAFCILFGFNKGVAFYSGLLLSQGGEFGFILFSLGKDSGVLEESTADILLLVVTFTMALTPLLAALGQKIAEKVDKGLGKTPTQMIELGARDLTNHIIIAGLGNTGKMVARVLEAEGISYVILDLDDDRVKEELSNGLPVFKGDVSQADTLKALGTERAFAIILTMNNQVTIKKSLKTISGNYQDIPVVVKLKNLKNAREFYDLGATTIIPESYETGLQIGGTVLKNIGISEQEINRIKVQFRLGNYIIAKKEDALSEAEDND

SEQ ID NO: 19783 - protein, 599 aa, Caulobacter crescentus CB15
MAQEVSPESYKDLVLFLATAGIVAPIFKRLKINPILGYLLAGVILGPFGLGRFIPYAPWLDYFTVDNPDEIAQLAEFGVVFLLFMIGLELSWERLRLMRRWVFGLGAVQVIGCSLALGAGGMLLGLEPVVALTIGAALTLSSTAIAVPVLAERRRLHSEAGRATFSVLLFQDLAVAPILITLAILGRGNGSFQLQDLLALAPAALGLAVIVLVGRLALRPMLKSVAKAKSEEMFMAACLLVIIGAGMVAALSGLSMALGAFVAGVLLAETEYRHEVEVKIEPFKGLLLSLFFVSLGIRLDLSLLAAQPAAILGTALGLLVLKTAVVFGSGLLMGLNRRAAIEAALILAAGGEFAFVLLDNAMSAQVVPPAIGQAVLVSATLTMFLIPGLAALGGYLGRKNAPLPVSEAPPSTANEPDRLGPEPAGQVLVIGYGRVGRLVGDMLGRHDLPWIAVEREARLVEQGRRDGARIYYGDASRLELLERCGLATARAVVVTMDAFEVAEAVVVAARGARPDVPIVVRARDARHAARLYELGATDAVPETIEASLQLSEAVLVDIGVPMGLVIASIHERRDEYRKKLNRPDALGGRRRRLRDATLR

SEQ ID NO: 19784 - protein, 506 aa, Silicibacter sp. TM1040
MTTPKPVVLCILDGWGSAEPGPANAPYLAKTPTLDAIMQSCPTARLVTHGPDVGLPSGQMGNSEVGHTNIGAGRVVAMDLGQIDLAIEDGSFYDNDALQAFIAKLKETGGAAHLMGLVSDGGVHGHVTHILAAIKAIRDAGVPVWLHAITDGRDVAPKSALTYLDQLEAGMAPGAQIATVTGRYFAMDRDNRWERVSEAYDAMVKGAGQFTAATARDAVENAYGRDELDEFVKATVVEGFDGIKEGDGFFCLNFRADRAREILRAIGEPGFAEFDTGPRPALAALLGMVEYSEGHNAYMTTAYPKRAIVNTLGEWVAKQGKRQFRLAETEKYPHVTFFLNGGKETPEVGEDRFMPKSPKVATYDLQPEMSAPEVTAKFVEAIRAGYDLIVTNYANPDMVGHTGDLDAAIKACEAVDQGLGEVVAALKDAGGAMIVTADHGNCELMVDPETGGAHTAHTTNLVPVALVGGPEGTALKDGRLADLAPTLLALMGLDQPEEMTGESLLV

SEQ ID NO: 19785 - protein, 336 aa, Pyrococcus furiosus DSM 3638
MKPKVFITRAIPENGINMLEEEFEVEVWEEEREIPREKLLEKVKDVDALVTMLSERIDQEVFENAPRLRIVANYAVGYDNIDVEEATRRGIYVTNTPDVLTNATADHAFALLLATARHVVKGDKFVRSGEWKRKGIAWHPKWFLGYELYGKTIGIVGFGRIGQAIARRAKGFNMRILYYSRTRKSQAEKELGAEYRPLEEVLKESDFVILAVPLTKETMYMINEERLKLMKPTAILVNIARGKVVDTKALIKALKEGWIAGAGLDVFEEEPYYNEELFSLDNVVLTPHIGSATFEAREAMAELVARNLIAFKRGEIPPTLVNKEVIKIRKPGFNEQ

SEQ ID NO: 19786 - protein, 339 aa, Oryza sativa
MERAAADRSGAEEGESEWREELRQQQSQVDALRERLVEVKVGMKCSEEDSRKELDHLCRRVKTIATLLAYLKSKARIMAIPHLAHTSCGIRHQDGVGYVDRNGVPLADWSKGGESASCEGLDDETSADSSRVAEHGDANEGDVDVEDILKSIHVVTDVMETLVKRVIVAESEAANEKEKVRMGLEEIRRKTIQVESMSAKVEEMEKFAVGTNGMLNEMRQRVEDMVLETTRQRQRAAENEQELSRVKHDFESLRTYVGTLVNVRETLLSSEKQFETMEKLFDRLVARTNQLESEKAQKEAEVQKVVEENVRLRAMIDKKEAQLQAMSEQCKFMALSRPN

SEQ ID NO: 19787 - protein, 92 aa, Vigna radiata
MGFRLPGIRKTLSARNEASSKVLDAPKGYLAVYVGENMKRFVIPVSHLNQPLFQDLLSQAEEEFGYDHPMGGLTIPCSEDLFQHITSCLSAQ

SEQ ID NO: 19788 - protein, 136 aa, Brassica napus
  misc_feature (21)..(21): Xaa can be any naturally occurring amino acid
  unsure (1)..(136): unsure at all Xaa locations
MLEKKAETFNMNRVIDDFDEXTRNADQVQKQTLKEILHKNKSAIYLRNFGINGDTTTDPEGDFKALVPLVTDSELEPYIKRMVDGDTSPILTGHPVPAISLSSGTSQGRPKFVPFTDELMENTLQLFRTAFAFRNR

SEQ ID NO: 19789 - protein, 84 aa, Candida glabrata CBS 138
MITEEHLREKLKTSIPDVYHVIVTDLSYGCGQSFDVVVVSNTFVGKNKIQRSRLVNGALKEELADIHAFSCKCYSEEEWSKIVI

SEQ ID NO: 19790 - protein, 194 aa, Triticum aestivum
  misc_feature (43)..(43): Xaa can be any naturally occurring amino acid
  misc_feature (108)..(108): Xaa can be any naturally occurring amino acid
  unsure (1)..(194): unsure at all Xaa locations
TSKGSKCWFVRYAPQNLAQIIEAIRGANKKGLSVSLDLASFEXVRDYRSQLMPLLETANIDLCFANEDEAREIIGGGLTYDPEDALAFLSKHCKWAVVTLASKGCIAXHGKQVVQVPAIGESNAVDATGAGDLFASGFLYGLVKGLPLEECCKVGACSGGSVIRALGGEVRPENWQWRYKQMHAGGLLLPELKN

SEQ ID NO: 19791 - protein, 401 aa, Coccidioides immitis RS
MPSLPSQDREEDRFTPAVEPMHAKSAEERNAFLSMLRKDSKSHREITDGYLNFWQADGGKARDDTEDERDGRMSKYMSLVNSYYDLATDIYEEAWAQSFHLCRFAIGEPLQQALARHEHYLAYRINLSPDMHVLDVGCGVGRPAREMATFTGCNVVGLNNNGYQIQRAKAHAERERLSHKVSFVKGDFMHLEFPENSFDAAYAIEATVHAPSLQGVYEQIYRVLKPGGTFGVYEWVMTDKYDDSDSRHRAIRLGIERGNGIVSMKTRKHAVDAIRSVGFVLDYEEDLAVYPDEIPWYAPLAGEFRSGGTLWERLTALRLTWMGRMAMSRLLGVLEGIRLAPPGTVETMNELSQGAEALLKDILSVLVFQTQSFMHHLSHAMDTGDGIRSPEKNGTEDLQFP

SEQ ID NO: 19792 - protein, 544 aa, Novosphingobium aromaticivorans DSM 12444
MKQTETAIADPKMHTETPWWRGAAIYQIYPRSFCDSNGDGIGDLNGIASRLDHVARLGVDAIWISPFFTSPMKDFGYDVADYCDVDPIFGTLADFDALVKRAHELGLKVTIDQVYAHTSDIHPWFAESRQDRTNARADWYVWADPKPDGSPPSNWQSVFGGPAWTWDARRCQYYLHNFLSSQPQVNAHNPEVQEALLGAMKFWLDRGVDGFRLDALNFLMHDPTLRDNPPAPDDGRRKTRPFDFQLKIYNQSHPDILKFIQRVRNLCDDYGAVFTVAEVGGDLAETEMKAFTAGDRHLNSAYGFDFLYADRLTPHFVEKAVAKWPDAPGMGWPSWAFENHDAPRALSRWCAPDQREPFARLKAMLFASLRGNIIVYQGEELGLTQVDIPFEQLQDPEAIANWPLTLSRDGARTPMPWLVQSGEGGFTSGAPWLPLGEENLSRAVDRQEGDPASLLNLTTRLLRLRRETPALRIGSFEVIHADECLLAIRRVLGEQSIAGLFNLSSVPVVWPHGLVREGKEMASVNGATVGQLPPFGALLIEERI

SEQ ID NO: 19793 - protein, 229 aa, Zea mays
  misc_feature (16)..(16): Xaa can be any naturally occurring amino acid
  misc_feature (24)..(24): Xaa can be any naturally occurring amino acid
  unsure (1)..(229): unsure at all Xaa locations
SSEYYEASARFAKWRXVLKIGERXPSELSMRENAYGLARYAVICQENGLVPIVEPEILVDGSHDIHKCAAVTERVLAACYKAISVPHVFLEGTLLKPNMVTPGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 19794 - protein, 296 aa, Lactobacillus plantarum WCFS1
MMSRDLDIANPARTRAIMHTYGLQVKKSLGQNFLTDQNVLHNIVATADIGTNDNVIEIGPGIGALTEYLARAAHHVLAFEIDDRLLPILDETLADYDNVTVVNQDILKADLAAMISEHLDNERPLKLVANLPYYITTPILMNILAGDVAFENIVVMMQKEVADRLAAEPGTKAYGALTIAVQYRMAAEMAMVVPRTVFVPSPNVDSAIVKLTALPLRTHVPFDEAAFFKVVKAGFAHRRKNLWNNLQSLFGKQPETKTAIQQALDIATIDPKIRAERLTVDEFITLTDALHQADLL

SEQ ID NO: 19795 - protein, 229 aa, Zea mays
MAAARRLSLPLVLLVVLAVAGRAAAQDYDFFYLVLQWPGAYCDTKQSCCYPKSGKPAADFRIHGLWPNRDDGTYPQNCSPDNAFNPSKVSDLLSSLRAKWPTLACPSNDGLRFWGHEWEKHGTCAADVFYEHGYFQAALRLRDQLGVLGALTSAGVKPDGGYYTLSQIKGAIRQGTGFEPYVECNRDEAGNSQLYQLYFCVDAAGDSFVDCPVLPSGRPCGNRIEFPAF

SEQ ID NO: 19796 - protein, 237 aa, Lycopersicon esculentum
MMKSQKKLLIKIIVVQCLLVLCVTSQDFDFFYFVQQWPASYCDTRRSCCYPTTGKPDEDFSIHGLWPNYKDGKWPQNCDRESSLDESEFSDLISTMEKNWPSLACPSSDGLKFWSHEWLKHGTCSALNQHAYFQTALDFKTKSNLLQNLNNAGIKPRNGDYYGVESIKKAIEKGVGHTPFIECNVDSQGNHQLYQVYLCVDSSASKFIDCPIFPHGGKCGSKIEFPSFSTNDDHDEF

SEQ ID NO: 19797 - protein, 325 aa, Rhodococcus sp. RHA1
MSDIDGMIDAVITEDVWGRAFNDLGTSRSILRAPHAWQDREKLLELGSRSRALVVRNRTQVDRQLIEACPSLRVIARAGVGLDNIDVKCANEAGVVVVAPLGANAISVAEHTIGMALAAVRRTVELDADCRRGGWERTPGRELHGGVWGLLGAGATGRACARLARSLGMSIVAYDPFADAEKLAQEGIELVEHPALVAARADVMSCHLPATRGTAHLINGELLTVMKPTAVLVNVGRGEVVDENALADALETGRLAAAALDVREVEPPLPGRLEKLGNVILTPHIAGITTHSQDRIIEVLADNIAAVLDNRSATAAVGTLREARS

SEQ ID NO: 19798 - protein, 265 aa, Yersinia pestis biovar Medievalis str. 91001
MKTTTMSQLRQWKQEKRKFATLTAYDASFAQLFAEQGIQVLLVGDSLGMTLQGFDSTLPVTVADMAYHTRAVRRGAPHCLLLADMPFMSYATPELAFTHAAELMRAGANMVKLEGGSWLCDTIRMLAERAVPVCGHLGLTPQSVNIFGGYKVQGREEVAANQLLQDAIALEQAGAQLLVLECVPVELAQRVTEELTIPVIGIGAGNVTDGQILVMHDALGITGGHTPKFSKNFLAHSAGDIRAAIKLYIEEVEGGIYPAEEHTFQ

SEQ ID NO: 19799 - protein, 987 aa, Glycine max
MERARRLANRAILRRLVSEAKQHQKNESVLHSSTTPMLLYSSSRCMSSVLRSRGSKTETLLGRNINMSRGVVVAAAGGFLGVGSARSISVEALRPSDTFPRRHNSATPEEQSKMAESCGFGSLDSLVDATVPKSIRLKDMKFGKFDAGLTENQMIEHMKDLASKNKVFKSYIGMGYYNTHVPPVILRNIMENPAWYTQYTPYQAEISQGRLESLLNYQTMITDLTGLPMSNASLLDEGTAAAEAMSMCNNIQKGKKKTFIIASNCHPQTIDICKTRADGFDLKVVTADLKDIDYKSGDVCGVLVQYPGTEGEVLDYGEFVKKAHAHEVKVVMASDLLALTVLKPPGEFGADIVVGSAQRFGVPMGYGGPHAAFLATSQEYKRMMPGRIIGVSVDSSGKTALRMAMQTREQHIRRDKATSNICTAQALLANMAAMYAVYHGPEGLKNIAHRVHGLAGAFALGIKKLGTVEIQDLPFFDTVKVKTSNAHAIADAALKSGINLRVVDGNTITVAFDETTTLEDVDNLFKVFAGGKPVSFTAASLAPEVQSAIPSGLVRKSPYLTHPIFNTYQTEHELLRYLYRLQSKDLSLCHSMIPLGSCTMKLNATTEMMPVTWPSFSDIHPFAPVDQAQGYQEMFNNLGELLCTITGFDSFSLQPNAGAAGEYAGLMVIRAYHLARGDHHRNVCIIPVSAHGTNPASAAMCGMKIVSVGTDAKGNINIEELRKAAETHKDNLSALMVTYPSTHGVYEEGIDEICNIIHDNGGQVYMDGANMNAQVGLTSPGWIGADVCHLNLHKTFCIPHGGGGPGMGPIGVKKHLAPFLPSHPVIETGGIPAPDKPQPLGTIAAAPWGSALILPISYTYIAMMGSKGLTDASKIAILNANYMAKRLENYYPVLFRGVNGTVAHEFIIDLRGFKNTAGIEPEDVAKRLMDYGFHAPTMSWPVPGTLMIEPTESESKAELDRFCDALISIRQEIAEIEKGNKSITEPV

SEQ ID NO: 19800 - protein, 75 aa, Arabidopsis thaliana
  misc_feature (51)..(51): Xaa can be any naturally occurring amino acid
  misc_feature (53)..(53): Xaa can be any naturally occurring amino acid
  misc_feature (60)..(61): Xaa can be any naturally occurring amino acid
  misc_feature (64)..(64): Xaa can be any naturally occurring amino acid
  misc_feature (69)..(69): Xaa can be any naturally occurring amino acid
  unsure (1)..(75): unsure at all Xaa locations
MASSMLSSTAVVTSPAQATMVAPFTGLKSSASFPVTRKANNDITSITSNGXKXVAAMKVXXPNXKEEVXTLSYLP

SEQ ID NO: 19801 - protein, 272 aa, Pseudoalteromonas tunicata D2
MSQTNIAFIGTGNMSYAIIGGMIKNGFNASQIIATNRNQTKLDKVASDFGVQTQTDNLIALAQADIIVLSVKPQMMAELCQTFANSGIDYSNKVFVSVAAGITVKRLREMLRSDVKLIRCMPNTPSLLGKGVSGLFSAGTSDAENSTVTEIFSSTGIVMWLEQESQINDIIAVTGSSPAYFFLFMEAIESKAKALGFTPEQARLLVQQTAMGAAQMVESQSIEISELRNNVTSKGGTTAQAIAHFQQHNLTQTVADAMDACIARAEQMETEL

SEQ ID NO: 19802 - protein, 417 aa, Colwellia psychrerythraea 34H
MIIANQNSLAKSKIKILLLEGLHPSSLEELKLKGYSNIESLKTSLSESELIEKIANVHFIGIRSRTQLTEKVLSHANKLVAIGCFCIGTNQVDLKAAQTRGIPVFNAPFSNTRSVAELVLGETLLLLRGIPEKSAKAHRGEWLKSAVGSVEARGKVLGIIGYGHIGMQLGILAETLGMRVRFYDVETKLPLGNASQAPSLDALLGESDVVSLHVPETAQTQNMIAQAQFEAMKQGAIFINASRGTVVDIPALAQALDSKKIAGAAIDVFPVEPKSNNDEFISALRGFDNVILTPHIGGSTKEAQANIGLEVATKLAKYSDNGSSLSAVNFPEVSLPDHSFPGQKNTSRLLHIHHNQPGVLTQINQAFAEHNINIAAQYLQTDDKIGYVVIDLDSEDSSLALEQLKHVDGTIRARILH

SEQ ID NO: 19803 - protein, 426 aa, Saccharomyces cerevisiae
MSHQNQLIPQAYISNFHNRLTNEDDGIPIFTMAQQTRQHKRAKVVNYAEYDNDLFDEFNMNGSNFNNADTHYKDNAVSHENTPALTNGVTMDGSEYNVLENMNGADSIISNNKYDAGSNMVVESLSGLNSNNNASNGPSNKAQAQDIGNAVLPDLQDQHHNPFNILRYPKIRDTFINGKVVSPYRLNTDQETKANANSGEAIMIPITLDIEHMGHTIKDQFLWNYNDDSISPEEFASIYCKDLDMTSATLQTQIANIIKEQLKDLENIAATEIMSDLHVIINLTCNLQDRFFEDNFQWNLNDKSLTPERFATSIVQDLGLTREFIPLISQSLHETILKIKKDWVDGHLIQDHVPNDAAFGYLSGIRLDIDELGSNWCPRVEILTKEEIQKREIEKERNLRRLKRETDRLSRRGRRRLDDLETTMRM

SEQ ID NO: 19804 - protein, 433 aa, Magnetococcus sp. MC-1
MDQRGGTMSRSASLFQQAAGLIPGGVNSPVRAFKSVGGIPPFIREAAGAMMTDEDGKSYIDYVGSWGPMILGHAPKEVVAAIQQAAVRGCSFGAPTSNEILLAQKLIELVPSLEMVRLVNSGTEATMSALRLARAATGRDAILKFDGCYHGHADSLLVAAGSGLATFGVPSSPGVTRGTAKDTLTVPFNDLAAVEACFAQHPEGIAAVIVEPVAGNMGCVLPRPGYLKGLRDICTKYGTILIFDEVMTGFRVDLRCAQGFYDVTPDLTCLGKVIGGGLPVGAYGGKMELMNQVSPAGPVYQAGTLSGNPLATAAGLATLEAISQPGFYETLTSRTQRLTVGIGKALDEAGIPHVSYHIGSMFGLFFTDAREVYNFADAAKNDHNRFKDWFHCMLEEGVYFAPSPYEAGFVSIAHDEAIIDLTIEKARKVAKTL

SEQ ID NO: 19805 - protein, 363 aa, Triticum aestivum
  misc_feature (235)..(235): Xaa can be any naturally occurring amino acid
  unsure (1)..(363): unsure at all Xaa locations
VKLPTRPRGPQLFYRERERERERERERDLRVGSPEEPSRTQPEGERSEGLAAKMAKLKELLDRSENRICADCSAPDPKWASANIGVFICVKCSGVHRSLGTHISKVLSVTLDKWTDDEIDSMVEVGGNSQANAIYEAFLPEGYRKPHPDSAQEDRQNFIKSKYELQEFLEPSLRIVSNHPSNAGKQASNSHSGSSKSEIGMVEFIGILNVKVIGGTKLAIRDVSSSDPYVVLTLXGQQKAQTSVIKGNLNPVWNEELKLSVPRKYGPLKLQVLDHDMVSKDDLMGEAEIDLQPMINAAASFGDPELLGDIQIGRWLKSGDNALTADSAVMVTGGKVKQEVSLKLQHTESGEVTVEMEWMALNI

SEQ ID NO: 19806 - protein, 438 aa, Leptospira interrogans serovar Copenhageni str. Fiocruz L1-130
MNFSHGTHDSHKRVYDTLRKCEQIFGFPLGIMADLQGPKIRTGKLKLNSILLHKNQEIEIVPDSDILGDEHKIGCTYPNLIRDIQEEDKILIDDGKLILKVISKKSNSAILKVIVGGILWSNKGINLPGTPISAPALSEKDIEDLKFALSLGVDYAALSFVRTGADLELARSYLEGTYTGLIAKIERPEAIGNIEEIIERADGIMIARGDLGVEIDTEKVPILQKELIYKLNQAGKPVITATQMLESMIENPRPTRAEASDVANAVMDGTDAVMLSAESANGHYPVESVEIMSKIIQETETIDHIYEIHWNIKKTFLESERTALGNAAREIAHGIHAKAIVNFTRSGYSALITSEMRPKVPIYSFTPFATTARKMKLYRGVVPFVMPFFTRLEDMIAYMNQKLKEDEFLFPGDKVVILSGAPGTTVRSVDFLQVYKIH

SEQ ID NO: 19807 - protein, 954 aa, Xanthomonas campestris pv. vesicatoria str. 85-10
MSQTPSSLRDLEHHSAFVERHIGPNDAEIAQMLDVVGHACLDALTDAIVPGNIKSPAPLALPEAITEEEALAKIRAIADKNTVFRNFIGQGYYGTHTPKVILRNILENPAWYTAYTPYQAEISQGRMEALINFQTLCADLTGMQIANASLLDEATAAAEAMTLAKRSAKSRSNTFFVHDAVHPQTLELLRTRAEPLDIVLRVGTPEEALQAECFGVLLQYPDSFGHIGDHAALADAVHAQGGLVAVATDLLALTLIAAPGEWGADIVVGNSQRFGVPFGFGGPHAAFMACRDAYKRSMPGRLIGVSIDAAGNPAYRLTLQTREQHIRREKATSNICTAQVLLAVMASMYAVYHGPDGLTRIARRTHRLAAILAAALRSAGVTVGERFFDTLHVKAIDANAIHARARAAGINLRAIDSEAVGISLDETSTRADVVALAALFGAQADVDALDAATADALPQGLLRTTPFLTHPVFNTHHSEHELLRYMRSLADKDLAMDRTMIPLGSCTMKLNATAEMIPVTWPEFGAIHPLAPAEQSAGYAQLIDELEAMLVECTGYDAVSLQPNSGAQGEYAGLLAIRAYHRSRGEAHRDICLIPESAHGTNPASAQMCGMTVVVTKCDANGNVDVDDIRAKAEKYSDRLAALMITYPSTHGVFEEDVVAICEAVHAHGGQVYTDGANMNALVGVAKPGKWGSDVSHLNLHKTFCIPHGGGGPGVGPCAVKSHLAPYLPKTLGGEGDVGMVSAASYGSASILPISWMYVTMMGSAGLRKATQVALLNANYIAKRLAPHYKTLYTGRNGLVAHECILDVRPLEKTSGIGAEDIAKRLIDFGFHAPTLSFPVAGTLMVEPTESESQHELDRFIDAMIQIREEIRAIEDGRLDREDNPLKHAPHTATQVSASEWTHAYPRELAAFPLPSLKQQKYWPPVARVDNVYGDKNVMCACIPVDAYKEDVEA

SEQ ID NO: 19808 - protein, 223 aa, Acidovorax sp. JS42
MSFPATFLSAPGDLPQEVTLAPLPAVIAAIAAGRPVLVLDDADRENEADLVCAAANMTEATMALMIREGSGIVCLCLTPAHAKALGLRPMVEVNRSAFSTAFTQSIEAAHGVSTGVSAADRLQTVRCALRIPAPGCAPEVVSPGHVFPLVARAGGVLERDGHTESAVDLAVLAGLPPAGVLCELMNPDGSMARGAQVARFARAHGLLCTTVRALADYRRARQP

SEQ ID NO: 19809 - protein, 726 aa, Arabidopsis thaliana
MEGAAVAEGLWGLADHHQKLGEIGKTIKCLEAICQSQISFLPLVEVKSRLRLAALLLRYSHNVNHAKSHLERSLLLLKSIPSSYDLKFQNYSLLSHCYHLLASFPPQRNLLVKALELASSVPQDISAYLWSCNFNSQLANTFIIQADFPSSLSALESGFLSASHICFPELQMFFTASMLHVHIMQWTDDYSVEKAVQRCDEIWQTISSDKTDRCPGLFFYNEMLHVFYRLRLCDYKNAQHHVDRLDQAMNAHSHKMQEIQQLLDELSSLNLSLSRYDLPSRERSALSARQSQLQDRVNALSPSSSTVNSLEPAYFGNIDRGWTEKLLLSPSPIDGEWLPKSAIDALVHLMVVISGRPKGLFKECSKRIESGLQIIQDELIKLGITDEVREADLRHTAIWMSRVFLMLQMQFLENRVALELTRSDYVEAEEALVDMKKWFTRFPTILQASECMIEMLRGQYSHSVGCYSEAAFHCIEATKLTESISMQASCQAFAAVSYLTIGDAESSSKALDLIGPLNGMTNSLSGVREEASILFAYGLLLMKQRDLQEARNRLAKGLQIAHNHMGNLQLVAQYLTLLGNLALSLHDTVQAREILRSSLTLAKKLYDIPTQLWVLSIFTALYQQLGEKGNEMENEEFRKKKWDELQSRLAEARGSIHHIELVAKARIELYQIDNNPQEQSLVASAQSMQGNLDIPESVGIEGPSPAPSSSRLVGLDTGKRWGKRRM

SEQ ID NO: 19810 - protein, 426 aa, Arabidopsis thaliana
MVCVACVEENKGCECEHEKPVRELVLEAASENSSFLHSVINMVGMLIGLGQLSMPYAVESGGWMSIFLLISFGILTTYTSHILGKCIRRNPKSKSYSDIGYSAFGRHGRLIVCLFIYLEIFMALVSYTISLHDNISAAFPATFSNHGHFPAAKLTAVAVAIALPSLWIRDLSSISFLSSGGILMSAIIFGSVVYTAIFGGVIDDGKIPVLRLENIPTVSGIYLFSFGGHIVFPNLYTSMKDPSKFTKVSIVSFATVTALYGALAITGAKMFGPSVNSQITLSLPKHLVVTKIALWATVLTPMTKYALEFAPLAIQLERSLPSTMTDRTKLVARGLMGSALLLVILALALTVPYFGYVLSLTGSLVSVTIAVTLPSAFYLKICWDGMTKFTRAANLGFVVLGCVLGVLGSFESSKLLVKELVRVHGG

SEQ ID NO: 19811 - protein, 172 aa, Triticum aestivum
HYRTSLYKKAGWYRSGIPGISSTHASADAWEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAAALEYPSRGPSLRVPSFLVQSGPYSESYYKLGTGRRFTTS

SEQ ID NO: 19812 - protein, 391 aa, Physcomitrella patens subsp. patens
MLATKTKPMIVSMGPHHPSMHGVLRLIVTLDGENVIDCEPILGYLHRGMEKIAENRTIVQYLPYVTRWDYLATMFTEAITVNAPEKLTNIQVPKRASYIRMIMLELSRVASHLLWLGPFMADIGAQTPFFYILREREMIYDLFEAATGMRMMHNYFRIGGVAVDLPYGWIDKCLDFCDYFLPKVNEYERLITNNPIFLKRVEGIGIIGKEEAINWGLSGPMLRASGVQWDLRKVDHYECYDELDWQIQWQKEGDSLARYLVRIGEMKESIKIIQQALKSIPGGPYENLEARRLQRGKKSEWNNFEYQFISKKPSPTFKLPKQEHYIRVEAPKGELGVFLIGDDSVFPWRWKIRPPGFINLQILPQLVKGMKLADIMTILGSIDIIMGEVDR

SEQ ID NO: 19813 - protein, 404 aa, Neisseria meningitidis MC58
MDKFPKSAKLDHVCYDIRGPVHKKALQLEEEGNKILKLNIGNPAPFGFEAPDEILVDVIRNLPTSQGYCDSKGLYSARKAIVHYYQTKGLRDITVDDVYIGNGVSELITMSMQALLNDGDEILIPAPDYPLWTAAATLAGGTVRHYLCDEENGWFPNLADMEAKITPKTKAIVVINPNNPTGAVYSREILLEIAELARKHGLIIFADEIYDKILYDGAVHHHIAALAPDLLTVTFNGLSKAYRVAGFRQGWMVLNGPKHHAKGYIEGLDMLSSMRLCANTPMQHAIQTALGGYQSINEFILPGGRLLEQRNRAWELVNQIPGVSCVKPMGAMYMFPKIDTEMYRIRDDMKFVYDLLVREKVLLVQGTGFNWIKPDHFRIVTLPYVHQIEEAMGRLARFLQTYRQ

SEQ ID NO: 19814 - protein, 338 aa, Solibacter usitatus Ellin6076
MRGTVLYGPRDIRFEDREDPRIEKPTDAVIRMAATCVCGSDLWPYRGIQATNGPTPMGHEYCGFVEEVGRAVKSVKPGQFVVGSFATSDNTCPHCQHGYQSSCAQREFVTRAQAPFLRVPLADGTLVPAPEAPSRDLIPSLLAASDVLGTGWFAADAANVKPGSTAVVVGDGAVGLLAVLSARQMGAGRIIAMSRHESRQKLAREFGATDVVSERGAEGIARIKELTNGVGADSVLECVGTMESMQQAIQVTRPGGFVSYVGVPQGVELDGQALFFAHVHLHGGPAPVRRYLPHLMDLVLNEKINPGRVFDLTLPLEQVAEGYRAMDERRAIKALLRP

SEQ ID NO: 19815 - protein, 395 aa, Hordeum vulgare
MALQAATSFLPSALSARKEGAAKDSAFFGVRLADGLKLDATSLGLRTKRVNTSSVAIRAQAAAVSAPTATPASPAGKKTVRTGNAIITGASSGLGLATAKALAESGKWHVIMACRDYLKTARAARAAGMPKGSYTIVHLDLASLDSVRQFVKNVRQLDMPIDVVVCNAAVYQPTAKEPSFTADGFEMSVGVNHLGHFLLARELLEDLKASDYPSKRLIIVGSITGNTNTLAGNVPPKANLGDLRGLAAGLNGVGSAAMIDGAEFDGAKAYKDSKVCNMLTMQEFHRRYHEETGVTFASLYPGCIATTGLFREHIPLFRLLFPPFQKYITKGYVSEEEAGKRLAQVVSEPSLTKSGVYWSWNKNSASFENQLSEEASDTEKARKVWELSEKLVGLA

SEQ ID NO: 19816 - protein, 337 aa, Vibrio angustum S14
MTDIRTLGEFIVEKQSDFPHASGELSSLLGSIKLAAKIVNREINKAGLVDITGTVGENNIQGEEQQKLDVYANDKFKAALEARDQVCGIASEEEDEAVGFDKPLNLNAKYVVLMDPLDGSSNIDVNVSVGTIFSIYRRVSPVGSPPTKEDFLQTGNQQVAAGYVIYGSSTMLVYTTGNGVHGFTYDPSLGSFCLSHENMTIPQDGVIYSINEGNYIRFPTGVKQYIKYCQEAVPEEKRPYTSRYIGSLVADFHRNLLKGGIYLYPSTASYPNGKLRLLYECNPMAFIIEQAGGKATNGFQRILDIPPTELHQRVPFFVGSTNMVEKVEGFLREYPDD

SEQ ID NO: 19817 - protein, 469 aa, Shewanella violacea
MSAESVLQQLKELEVKFVDLRFTDTRGKEQHVSIPSHQVDEDFFEDGKMFDGSSINGWKGINESDMVLMPDPASFVLDPFTAETTANIRCDILNPGTMTGYNRDPRSIAKKAEEYLRSTGIADTVLLGPEPEFFLFDDVKYGADMSGCFYKVDAEEAAWNSGTSYEGGNKGHRPSVKGGYFPVAPVDSSQDIRSAMCLVLEEMGQVVEAHHHEVATAGQNEIATRFNTLTLKADEVQVLKYVVHNVAHAYGKTATFMPKPIVGDNGSGMHVHISLAKDGTNLFAGDKYGGLSEMAIYFIGGVIKHARAINAFSNPATNSYKRLIPHFETPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSNDFIDSYITLKSEDVERVNQTTHPVEFELYYSL

SEQ ID NO: 19818 - protein, 176 aa, Arabidopsis thaliana
MGNALVKKEPPPPVVLVPPLFDYPPLSARTRMLESSYNLLFGKLALRCLFEDYFEEANRFTGKFLLKPTDDPHVDLVASVSGAVDGRVEGDFVGNAEFRWQSDVDDPHTFVDLSVSTSNPVLLMRSSAYYPKYGIGAFAVYPLISKITGKSSEEYRIMGLRYGSTKLSVGATVTSF

SEQ ID NO: 19819 - protein, 270 aa, Aspergillus niger
MSFLPSVGMLALGAMQLSSGALATIDTCSSDSPLSCQTDNEASCCFNSPGGSLLQTQFWDYDPSDGPSGSWTIHGLWPDNCDGTYQEYCDESREYSNITSILEAQNRTELLSYMKEYWPDYEGADEDESFWEHEWNKHGTCINTIEPSCYTDYYAQEEVGDFFQQVVDLFKTLDSYTALSDAGITPSEDATYKLSDIEDALAAIHDGYPPYVGCEDGALSQLYYYFNVKGSAIGGTYVASERLEDSNCKDSGIKYPPKYSSSKKIYGSSL

SEQ ID NO: 19820 - protein, 456 aa, Ashbya gossypii ATCC 10895
MNRAAKPSHKPMQQTSPAPVTQPTDTYVQPFLKELIPELKSLESLRDAERRMDVYISRKKIDLHQSITQWTYQKQRDYSESQFLRVFISTIAENQPWQTNSDDLDQGTWTLRIEGRLVNDENVQVPTRPKFSTFLQSIALDFHGQDGRAEDGDGDQLMDDEGVPAVMPQRKYDIVEWHADPNTPVEFDGLDIKRQGTENVDCTITIQPKGYSGDQLQYSDALAFIIGVARGTVHEAIYSLYKYILLNELLVADPSGNAKSTQNDDKMVIKVDAMIAKLLPPAAEPRKYLKLTELPQVVNAHIKPIPPVRINYTIQVDKTSTYGELVFDIRVPRVPVKDPEPASAQNSLAQQGMLLLTEFNTVTSQLEPQLATLEKKTQLLSLQLSSTANKYQFFNKLADDPVPMLNDYIKATSNALKVLSGDDGFDEDTVRRSNFYQENEAVLFENLGVLLSNGRM

SEQ ID NO: 19821 - protein, 808 aa, Arabidopsis thaliana
MGIHLGEIGIVLFPWFLWLSLFLSCGYAAITISSPLTLGQTLSSPGGFYELGFFSPNNSQNQYVGIWFKKITPRVVVWVANREKPITTPVANLTISRNGSLILLDSSKNVVWSTRRPSISNKCHAKLLDTGNLVIVDDVSENLLWQSFENPGDTMLPYSSLMYNLATGEKRVLSSWKSHTDPSPGDFVVRLTPQVPAQIVTMRGSSVYKRSGPWAKTGFTGVPLMDESYTSPFSLSQDVGNGTGLFSYLQRSSELTRVIITSEGYLKTFRYNGTGWVLDFITPANLCDLYGACGPFGLCVTSNPTKCKCMKGFVPKYKEEWKRGNMTSGCMRRTELSCQANLSTKTQGKGVDVFYRLANVKPPDLYEYASFVDADQCHQGCLSNCSCSAFAYITGIGCLLWNHELIDTIRYSVGGEFLSIRLASSELAGSRRTKIIVGSISLSIFVILAFGSYKYWRYRAKQNDSWKNGLEPQEISGLTFFEMNTIRAATNNFNVSNKLGQGGFGPVYKGTLSDKKDIAVKRLSSSSGQGTEEFMNEIKLISKLQHRNLVRLLGCCIDGEEKLLIYEFLVNKSLDTFLFDLTLKLQIDWPKRFNIIQGVSRGLLYLHRDSCMRVIHRDLKVSNILLDDKMNPKISDFGLARMFQGTQHQDNTRKVVGTLGYMSPEYAWTGMFSEKSDIYAFGVLLLEIISGKKISSFCCGEEGKTLLGHAWECWLETGGVDLLDEDISSSCSPVEVEVARCVQIGLLCIQQQAVDRPNIAQVVTMMTSATDLPRPKQPLFALQIQDQESVVSVSKSVNHVTQTEIYGR

SEQ ID NO: 19822 - protein, 272 aa, Staphylococcus aureus subsp. aureus MRSA252
MKTVSQLIDMKQKQTKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEKAGAVALVLEAIPNDLAEEISKHLTIPVIGIGAGKGTDGQVLVYHDMLNYGIEHKAKFVKQFADFSVGVDGLKQYDQEVKSGAFPSEEYTYKKKIMNEVNNND

SEQ ID NO: 19823 - protein, 504 aa, Candida albicans SC5314
MSHSSLSWLSNFNVETVPSKYLRRSSIIGTIGPKTNNVDVLVKLRKAGLNVVRMNFSHGSYEYHQSVIDNARKSEEVYKGRPLAIALDTKGPEIRTGTTIGDKDYPIPPNHEMIFTTDDAYKTKCDDKVMYIDYKNITKVIAPGKIIYVDDGVLSFEVISVDDEQTLKVRSLNAGKISSHKGVNLPGTDVDLPALSEKDIADIKFGVKNKVHMIFASFIRTANDVLEIRKVLGEEGKDIQIISKIENQQGVNNFDEILEVTDGVMVARGDLGIEIPAPQVFVVQKQLIAKCNLAAKPVICATQMLESMTYNPRPTRAEVSDVGNAILDGADCVMLSGETAKGNYPVEAVSMMHNTCLTAEKAIAYPQLFNELRSLAKKPTATTETCAVAAVSAAYEQDAKAIVVLSTSGLSARLVSKYKPDVPILMVTRNERAAKFSHLYRGVYPFIYDKPSIENWQEDVENRLRWAVSEAVELGIISKGDSIVTVQGWTRGSGHSNTVRIVQA

SEQ ID NO: 19824 - protein, 239 aa, Triticum aestivum
MAAPPSSVSVRAGASVSAKLTPRQAARAGFGGRVSVSSGRKCGGPVRASLFSPKPAVAMDARPTKVQELHVYELNERDRESPAYLRLSAKQSQNALGDLVPFTNKVYNGSLDKRIGITAGICILIQHVPERNGDRYEAIYSIYFGDYGHIAVQGPYLTYEESYLAVTGGSGVFEGAYGQVKLNQIVFPFKIFYTFYLKGIPDLPKELLCAAPVPPSPTVEPTPAAKATEPHACLSNFTD

SEQ ID NO: 19825 - protein, 570 aa, Candida glabrata CBS 138
MAGEKVELSSMDSAIEIRHVNQHAKEISSENKSESYDDNKEFEGSNRVVIKPVNDEDDVSVMINFNQGVSHFIIMLTFVASLSGFLFGYDTGYISSALISIGTDLDNKELTYGEKEITTAATSLGALIFALVAGFSVDIFGRKPCLMFSNIMFLIGAILQVTAHKFWQMTAGRFIMGFGVGIGSLIAPLYISEIAPKMIRGRLTVINSLWLTGGQLIAYGCGAGLNHVHNGWRILVGLSLIPTVLQFVFFIFLPDTPRYYVMKGDYEKAKSVLKRSYNGVSDELIDRKIEELLALNQSIPGKNHVERTWNAVKELHTKPANFRALIIACGLQGIQQFTGWNSLVYFSGTIFESVGFKNSSAVSIIVSGTNFIFTLVAFFCIDKIGRRNILIIGIPGMTVAHVMSAIAFHFIGIKFVGNTAIVEHSGFSSWGIVIIVFIIMFAAFYALGIGTVPWQQSELFPQNVRGVGTAFATATNWAGSLVIASTFLTMLQNITPTGTFGFFAGLCVVSFFFCYFCYPELSGLELEEVQTILQDGFNVQASKELAKKRKRQIAVLKKAKHQPTEEIIEE

SEQ ID NO: 19826 - protein, 299 aa, Aspergillus nidulans FGSC A4
MSTKPTTQTLCILGCGNLGTAILKSVLATPEPDRLFTHYIACIGSPSSKERLEFQFKDQANLTIALDDNIAAIRAADVVILALDPALIPAGLAQPGFRDALGQKLLISVAAGWTVKKLTETIYGDGLAEEGKARATIIRTLPNICALVGQSLTAIEVDPAAKTAEEALSLTTSIFSRVGKTLIIPPSLIDATTAVAGSTPAMFAVIVDSMIDASVAVGVPRSMAQAMIYQSMRGSAEMLQSGLQPGDLRDQGTSPEGCTIGGLMVMEERGVRGGVGRAVREAVSVARRMDGRLHLNDTR

SEQ ID NO: 19827 - protein, 601 aa, Legionella pneumophila str. Lens
MNGHLLLNVFIFLAAASIMVPLASRFRLGSVIGYLTVGMLIGPFGLKLIGNAEQIMHFAEFGVVMMLFLIGLELEPIMLWKLRKLIVGLGGLQVLLTTIALSSAAVMMGYNLRASVAVSMALALSSTALVLQMLQEKNLLKTAEGETSFAVLLFQDIAVIPILVILPLLGNHHGINVAINPHTAASIAQLPKWLHAIVVAGIIGSIVLAGHYLSRYLFLIIAKTNIREVFTAFSLSLVVGITLLMETIGVSPALGAFIAGMVLANSQYKRTVEADIQPFKGLLLGLFFISVGMGINFNLLFSQMAVIIPIVLGLITIKALILFTLGKIFQLTKIQALGFALGLSQGGEFAFVLFQYSSTLKVISPEISSFFTLVVALSMLATPFLMLLYHRFMMPKLISKLPEREYDSIHEKNNIIIAGYGRFGQIIGRFLSGENIKVTVLEKNPEQVELLRKFGYTGYFGDANRLDLLKSAGAAHAQLLIVTVGNPDTNLEIVKLAKEEFPQLKIFARARNRRHAYELHKAGVHYFKRELFDSSLTMTKEILKFLGYKPEEIEKKANAFQKHDEETLIKSFDFFEEEANLINFSRQAKGELERILQNNNP

SEQ ID NO: 19828 - protein, 392 aa, Sulfitobacter sp. EE-36
MQLSSRITGLLGGGSDGWGVFLRARQMIEQGTQVTELTIGEHDIRTAAPILQDMHRAALAGHTGYAAIPGTTGLRDAVAARLQERTGVPTTRDNVLITPGGQSALFAAHMATCNPGDTALYIDPYYATYPGTIRGVSALPHAIAARAEDAFQPRADVIAAAAKQTNAASLLVNSPNNPTGVVYSRKTLEGIAQVCRDHDMWLISDEVYDTQVWEGAHLSPRALDGMAEHTLVVGSMSKSHAMTGSRCGWIVGPVDAIEHLTNLATHTTYGVPGYIQDAALFALNQGTGFETEIAAPFQRRRLLAQDILARQNAVSLVPAQGAMYLMLDVRSTGMSGEDFAYALLEKHHIAVMPGESFGTAAAGHIRVAMTIEDTRFAQALATVCDFAEGLAA

SEQ ID NO: 19829 - protein, 602 aa, Pseudomonas aeruginosa UCBPP-PA14
MVFLIAAVFMVPLAKRLQLGAVLGYLLAGVLIGPSVLGLVDNPESVAQISEMGVVLLLFIIGLELSPRRLWVMRKSVFGVGLLQVLLTGVVIGTVALVGFDQPVNSAVVLGLGLALSSTAFGLQILAERKELTQPHGRLAFAILLFQDIAAIPLIAMIPLLSGAHSDAGGSELTQTLKVVGSIAAVVVGGRYLLRPVFRIVAQTKLQDMSTATALLVVMGTALLMELAGVSMALGAFLAGLLLADSEYRHELEAQIEPFKGLLLGLFFISVGMSADISLLLKSPWMVLGLTVLLIALKAPVLYFVGRISGGLDKASALRLGVVLAAGGEFAFVVFKMARDQGLFQNDLHNLLVLSITLSMALTPLLVLGLARLLAKEPEATKPPPEMERIDNDDTPRVVIAGVGRMGQIVARVLRAQRVPFIALDTSVETIELTRTLGAIPIFYGDPMRPEILRAAQVEKAEFFVIATDDPETNIETAKRVRKLYPHLKIIARARNRQHVHLLLDAGVEPVRETFFSSLEMSRMVLCGLGLSEEQADARIRRFRRHDEEVLASQHLFYNDRDALIKSAREARVELETLFQTDQLEDRGAVAAETPEKPSRAS

SEQ ID NO: 19830 - protein, 469 aa, Shewanella benthica
MSAESVLQQLKELEVKFVDLRFTDTRGKEQHVSIPSHQVDEDFFEDGKMFDGSSINGWKGINESDMVLMPDPESFVLDPFTADTTAIIRCDILNPGTMTGYNRDPRSIAKKAEEYLRSTGIADTVLLGPEPEFFLFDDVKYGSDMSGCFYKLDAEEASWNSGTSYEGGNTGHRPSVKGGYFPVPPVDSSQDIRSAMCLILEEMGQVVEAHHHEVATAGQNEIATRFNTLTLKADEVQVLKYVVHNVAHVYGKTATFMPKPIVGDNGSGMHVHISLAKDGTNLFAGDKYGGLSELAIYFIGGVIKHARAINAFSNPATNSYKRLIPHFEAPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSSDFIDSYITLKTEDVERVNQTTHPVEFELYYSL

SEQ ID NO: 19831 - protein, 212 aa, Candida glabrata CBS 138
MVQFMEIKDAIEHFKQNKFVIVMDDEDRENEGDLICAAANVTPEHIAFLVRHSSGYVCTPMSNKIADRLDLPLMRDNLKCESADDDRHGTAYTITVDVSEGTTTGISAHDRALTCAKLADPSAKPKDFLKPGHICPLRAKDGGVITRQGHTEAAVDLCRLSGLPEVGVICELVNDRDGSMMRLNDCAEFGKKFDIPIITIQSLIKYIKENNL

SEQ ID NO: 19832 - protein, 229 aa, Lactobacillus johnsonii NCC 533
MKRKLAKLVLVRHGESVANRDNVYTGWNDVPLSKKGIAQAKNAGLKVEKIAEFAPTHIHTSVLSRAIMTANIIADVCSFLYLPITKTWRLNERHYGALRGINKDVSKKIFGTNQVLEWRRGFDSVPPLLTQPVQDRRYQKYDMRLMPQGESLHQTQERLMPYFWDHIAPELMAGHDQLVVAHGSSLRALIKKIEDISNEDIVKVEVPNAEPIVYTFDTDLHIVKKEILH

SEQ ID NO: 19833 - protein, 477 aa, Neisseria meningitidis MC58
MNEYSQLIKHPDISLPPVSDGIKVDNPATGETLAFVRKTDSDKLKNLIQKAAAAQKLWAAKTALERADVLWRWYFQIKENKEALARLMTMEQGKSLTEARGEIDYAASFVRWFAEEARRIDGDVLTSVKASQKLVVLKQPVGVTAAITPWNFPSAMIARKAAPALAVGCAMIVKPASLTPLSAYALASLAYEAGIPQDLLPVVSGSASEIGHEFATNPIIRKISFTGSTEVGAKIFADSAADIKKLSLELGGNAPFIVFDDADLDKAVEGALASKFRNSGQTCVCTNRVYAQSAIYDEFCRKLSEKAAALKLGNGLEDGVNQGPLIEEKAVEKVEQHIADALAKGASCLTGGKRSALGGTFFEPTVLSGVTAQMAVAREETFGPLCPVFRFETEAEVIEAANNTEYGLAAYLFTADTARQWRVGEALEYGMVGINTGLISNEAAPFGGVKRSGLGREGSKYGADEYLELKYLCMDVG

SEQ ID NO: 19834 - protein, 168 aa, Glycine max
  misc_feature (49)..(49): Xaa can be any naturally occurring amino acid
  misc_feature (145)..(145): Xaa can be any naturally occurring amino acid
  unsure (1)..(168): unsure at all Xaa locations
MIYSPSVTTVNRAGADMGATFTDLNSMAGFPIIKTNNDITSIDTNNGRXQCIQVWPPIGNKKFETLSYLPYLDDAQLAKEVEYLLKKGWIPCLEFKSEHGFLCREHNKTPGYYYRRYCTMWKLPIEGCTDANNVVEEDKHDKTAXPNWLISIFRNDNEMQVHCISVNY

SEQ ID NO: 19835 - protein, 142 aa, Arabidopsis thaliana
  misc_feature (89)..(89): Xaa can be any naturally occurring amino acid
  misc_feature (97)..(97): Xaa can be any naturally occurring amino acid
  misc_feature (101)..(102): Xaa can be any naturally occurring amino acid
  misc_feature (107)..(107): Xaa can be any naturally occurring amino acid
  misc_feature (111)..(111): Xaa can be any naturally occurring amino acid
  misc_feature (115)..(115): Xaa can be any naturally occurring amino acid
  misc_feature (117)..(117): Xaa can be any naturally occurring amino acid
  misc_feature (123)..(123): Xaa can be any naturally occurring amino acid
  misc_feature (125)..(126): Xaa can be any naturally occurring amino acid
  misc_feature (133)..(135): Xaa can be any naturally occurring amino acid
  misc_feature (137)..(137): Xaa can be any naturally occurring amino acid
  misc_feature (139)..(140): Xaa can be any naturally occurring amino acid
  unsure (1)..(142): unsure at all Xaa locations
MASSMLSSTAVVTSPAQATMVAPFTGLKSSASFPVTRKANNDITSITSNGGRVSCMKVWPPIGKKKFETLSYLPDLSDVELAKEVDYLXRNKWIPCXFDSXXEHGIXCNRXHGNXPXYYDGRXWXXLEVSIFXXXTXSXXSF

SEQ ID NO: 19836 - protein, 138 aa, Triticum aestivum
  misc_feature (124)..(124): Xaa can be any naturally occurring amino acid
  unsure (1)..(138): unsure at all Xaa locations
DDLIKNAGYISTPDTGILADDEYTDTIAKRYVSINVENVEDNLRALRELLYCTPGALQYLRGVILLEETLYQSSKGGEPFGDILMAGTDRPGINVDKGTIELAGTNGETTTHGFDDLGMRCTKXYDVAAQFDKRREAP

SEQ ID NO: 19837 - protein, 367 aa, Thermoplasma volcanium GSS1
MEEWTEVNFGPQHPSMHGVLRLKVKLDGEIVKDVEPIIGYLHRNAEKICELQFYCDNMIYFDRMDYVAAMNMEIGYLEAAEKLLDVEPPGRAKWIRVMMGELNRIASHLVWLGAFGLDLGMLTPFFYCFKEREKILKIFTEVSGSRQQLNYMSIGGVYQDVTDEALDHIKQFITEFPKELNMIANLFVKNDIFLSRTKGVGILSKEMAIDYGVTGPMLRASGVEYDVRKAEPYLVYDKVNFDIPVSFKGDNLARFLVRIEEMRQSVKIIDQTIQKLPAGPYFNQKAKKPLMIRLRGQGEVYARTESPKGEFGVYIVGDGSLRPYRVRVRSPTFKNLSVLPALAKGQMIADLISIGGSIDLVFGEVDR

SEQ ID NO: 19838 - protein, 262 aa, Triticum aestivum
  misc_feature (198)..(198): Xaa can be any naturally occurring amino acid
  unsure (1)..(262): unsure at all Xaa locations
TASRRSRPVPAAEVGRKEADRVEALPGQPSGVDFAQYAGYVTVDAPAGRALFYYLAEAIGGNGNGDGSSSKGKPLLLWLNGGPGCSSLGYGAMEELGPFRVMSDGKTLYRNPYSWNHAANVLFLESPAGVGYSYSNTTADYDRSGDNRTAEDAYAFLVSWMERFPEYKGREFYIAGESYAGHYAPQLAHAVLRHATPXINLKGVMIGNAVINDWTDSKGMYPHLHPYLSQYIDTTENELKKYSREKEKNSVRQLNDFVLSFP

SEQ ID NO: 19839 - protein, 106 aa, Methylococcus capsulatus str. Bath
MRQLTPHQVKALLDEPEAAPLLLDVREPGEFAFCHIDGSLHIPMGEIVSRLGELDPDWTTVVVCHHGMRSFQVARFLETQGFGRVINLAGGIDAWAREADPGMPRY

SEQ ID NO: 19840 - protein, 256 aa, Botryotinia ficariarum
AYMLKYDSTHGQFKGDIKVLSDGLEVNGKKVKFYTERDPANIPWAESEAYYVVESTGVFTTTEKAKAHLKGGAKKVVISAPSADAPMYVMGVNNETYKGDVDVISNASCTTNCLAPLAKVINDEFTIIEGLMTTIHSYTATQKTVDGPSAKDWRGGRTAAQNIIPSSTGAAKAVGKVIPELNGKLTGMSMRVPTANVSVVDLTVRIEKGASYDEIKAVIKKAADGPLKGILAYTEDDVVSTDMNGDNHSSIFDRKA

SEQ ID NO: 19841 - protein, 1049 aa, Bacillus megaterium [sequence omitted]

SEQ ID NO: 19842 - protein, 143 aa, Colwellia psychrerythraea 34H
MAIERTFSIVKPDAVAKNFIGQIYNRFETAGLKIVASKMIHLSQEKAEGFYAEHSERPFFGALVEFMTSGPVMVQVLEGENAVLKNREIMGATNPAEALAGTIRADLADSIDENAAHGSDALESAAREIAYFFSDDEICARTR

SEQ ID NO: 19843 - protein, 259 aa, Arabidopsis thaliana
MPQGDYIDLHRKRNGYRLDHFERKRKKEAREVHKHSTMAQKSLGIKGKMIAKKNYAEKALMKKTLKMHEESSSRRKADENVQEGAVPAYLLDREDTTRAKVLSNTIKQKRKEAGKWEVPLPKVRPVAEDEMFRVIRSGKRKTKQWKRMVTKATFVGPAFTRKPPKYERFIRPSGLRFTKAHVTHPELKCTFCLEIIGIKKNPNGPMYTSLGVMTRGTIIEVNVSELGLVTPAGKVVWGKYAQVTNNPENDGCINAVLLV

SEQ ID NO: 19844 - protein, 374 aa, Silicibacter sp. TM1040
MSYETPGPVESELRDAISPIEEIIDAARAGKMYILVDHEDRENEGDLIIPAEFADADAINFMATYGRGLICLPMTAERIDRLGLPMMAVNNSSRHETAFTVSIEAREGVDTGISAADRALTVATAINEQNTMAAIATPGHVFPLRAKRGGVLVRAGHTEASVDISRIAGCHPSAVICEIMKDDGTMARLPDLVEFAKTHDMKIGTISDLIAYRAKNDNLVDETARSTVTSEYGGDWEMRIFTDQTHDVEHVVLIKGDITTPEPVLTRTHALHEASDLLGLGPKPAGELPRAMELIADEGRGIVCLFRQPRNALYASDEEGVRTIKQTGLGAQILNKLGVEELILLTDSPQTKYVGLDAYGLSIVGTRPILSRDS

SEQ ID NO: 19845 - protein, 394 aa, Zea mays
LGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19846 - protein, 461 aa, Burkholderia pseudomallei K96243
MATDQDNDGLKRGLKNRHIQLIALGGAIGTGLFLGIAQTIRMAGPSVLLGYALAGVVAFFIMRQLGEMVVDEPVAGSFSYFASKYCGHFTGFLSGWNYWVLYVLVSMAELSAVGIYVQYWWPGVPTWISALVFFVVINAVNLASVKSYGETEFWFSIVKVAAIIGMIGFGGYLLLSGHAGPDAGVANLWRHGGFFPNGIGGLAMAMAVIMFSFGGLELVGITAAEADDPSHSIPRATNQVIYRILIFYIGALGVLLSLYPWQKVVTGGSPFVLIFHALSSDIAASVLNVVVLTAALSVYNSCVYCNSRMLYGLAQQGNAPQALARVNRRGIPIAALGVSAFATALCVVINYFMPGKAFELLMGLVVSAIIINWAMISVIHLRFRQAKRAAGETTRFRSLGYPLTNYFCLAFMAAILVVMFRTPELRLSVYLIPVWLVVLALGYRFRQRGAGYALGGGVSAR

SEQ ID NO: 19847 - protein, 129 aa, Arabidopsis thaliana
  misc_feature (7)..(7): Xaa can be any naturally occurring amino acid
  unsure (1)..(129): unsure at all Xaa locations
TPGSDSXKVAPELIAEYTVTALRRTVPPAIPGIVFLSGIQREEQATLNLNAMNKLDVLKPWTLTFSFGGALQQSAIKAWAGKPENVAKAQAKFLTRCKANKDATLGKYTGWASGDSAAFENLVVIGYRY

SEQ ID NO: 19848 - protein, 394 aa, Zea mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 19849 - protein, 270 aa, Mycoplasma genitalium G37
MDTYTSAKINWFPGHMKKIHDQLKKLSSQIDGIIEIVDARAPTLTHNSEIISYFLNKPKLILALKTDLAQYKPNKKILFGSLKEPFKLKKKVLKTLTTLFANKRQQLKAKGLLIKQFRLAVIGMPNVGKSSLINLLINKNHLKVANRAGITKSLNWIQISPELLLSDTPGVFLKRIDEIQIGYKLVLTNVIRREVVNIEEVGMFAFNYLKKHYKQLLPFEADSFINFLEKFAKVRGLIKKANELNTNLACEIFINELINGKYGKLSYELN

SEQ ID NO: 19850 - protein, 394 aa, Zea mays
LGSARRARLPPGEMGWPLVGGMWAFLRAFKSGKPDAFIASFVRRFGRTGVYRSFTFSSPTVLVTTAEGCNQVLMDDDAFVTGWPKATVALVGPRSFVPIPHDEHRRIRKLTAAPINGFDALTGYLPFIDRTVTSSLRAWADHGGSVEFLTELRRMTFKIVVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19851 - protein, 394 aa, Zea mays
LGAERRARLPPGEMGWPLVGGMWAFLRAFKSGKPDAFIASFVRRFGRTGVYRSFMFSSPTVLVTTAEGRKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 19852 - protein, 394 aa, Zea mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 19853 - protein, 427 aa, Bradyrhizobium sp. BTAi1
MRSKAHSLIPGGAHTYAKGDDQYPVLAPSFLTRGEGCHVWDIDGNEFIEYGMGLRAVTLGHAYKPVVEAAHRQMLLGENYTRPATIELTCAEEFLGLIEGADMVKFAKNGSDATTAAVRLARAYTGRDLIARCGDQPFFSTDDWFIGNTPMSAGIPKVVQDLTLQFRYNDIESLRSLFAQHPGEIACVIMEAATAVEPQPGFLHAVQALCRKEGAVFILDEMITGFRWNVGGAQREYGITPDLSTFGKGIGNGFSVSALAGKRELMELGGLRDDRERVFLLSTTHGAENHALAAAIATMQVYRNDHVIEHLHRQGERLRAGVNPVIKELGIGDHFELLGRASNMVFATRDTAKQPSQPFRTLFLQEMIKRGIITPSLVVSFSHTDADIDRTIEAIAESLKVYRSALEDGVDHYLVGRPVKPVFRKFS

SEQ ID NO: 19854 - protein, 601 aa, Vibrio angustum S14
MSNDFLVLSVVFLAAAIIAVPLAQKLGLGSVLGYLIAGIAIGPWGLGLISDVDAILHFSEFGVVLLLFLIGLELNPKTLWQMRKPILGLGGGQVVITSGVIAVVVMSLNGFLPSLTWRDAAVIGMGLALSSTAIALRVIEEQQLSGSETGQSGFAVLLFQDIAVIPMLALLPALAGGKGGSWNDAFWMLGGIAVLLVGGHFLLRPLFRYVVMSGVRELFNVAALLLVLGIALIMQALGLSMALGAFLAGVLLAESEYRHELEIAIEPFKGLLLGLFFISVGMAVNIGLLWQYPLQILAAVFALVAVKGVVLYLLARIFGVREKSRSQMAAILSQGGEFAFVLFTAARAEGLLDAQLLAFLLVVVSISMMTTPLVLTLQNRWFVRSFKASEQPEPESDIVDRAPRVIITGFGRFGQVIGRLLFANKIKVTVLERDPSQIQFLRKFGYKVFYGDATQLDLLRAAGADNAEAIIICTDAPTEVMEVVAICQQHFPHLKILARARSRVEAHQLLGQGVECFSRETFAGALDLGRQALISLGMHPYKAKRAEAHFRKIDTQALRDLLPQHSEEVNLASRQKEARKELEEIFDREMRGEEERHHGWD

SEQ ID NO: 19855 - protein, 482 aa, Salmonella enterica subsp. enterica
MSDVPLIAVVMAGGTGSRLWPLSRELYPKQFLQLSGKNSLLQTTLLRLSALACNEPLVITNEQHRFIVAEQLRQIDQLHNNIILEPYGRNTAPAIALAALSALRRKEQEDPLLLVLAADHIIAKEEVFCNAVKKAVPIAENGNIVTFGIIPEYAETGYGYIERGVPFSVNANSTETDFYHVKKFVEKPDRLKAEKYISTGDYFWNSGIFMFKATVYLNELKKFRPDIYSVCEQVLSSSYRDLDFIRLPETLFKDCPAESIDFAVMEKTERCIVCPIDIGWSDVGSWQSLWDISEKTDEGDVCKGDILTYNTKNNYIYSESALVAAVGVEDIVIVQTKDAILVSKKSDVQDVKKIVEMLKAQERTEYIAHREVFRPWGKFDSIDQGERYKVKKIIVKPGEGLSLRMHHHRSEHWIVLSGTAKVTLDDKTMLVTANESIYIPLGATYSLENPGVIPLNLIEVSSGDYLGEDDIVRQKERYKKDN

SEQ ID NO: 19856 - protein, 421 aa, Thermoplasma acidophilum
MGSKDLFQRGSSLFPMGVNSPVRYFKDYPFYVDNASGSRIYDVDGNEYIDYCLAYGPSILGHADPDVVRAVRDQAEKGLIYGAPSEAEIRLGDIIRRSSKNIEMMRFTNSGTEATMHAIRLARAYTGRSIIVKMEGGFHGAHDYSLIRSGSGTLTFGSPSSPGVPEEVARTVVVGRYNDEANIRNIFSQYGSRIAAVITEPIMGNAGVITPEPGFLEFLRDITQKNGSLLIFDEVITGYRFAFSPYQDIIGIRPDLTTMGKIIGGGMPIGLFGGSADIMKKVSPSGDVYQSGTFSGNPVTMAAGFAALKKLQGMDYASLVRRTEKLMNGIDDILAKRKIRHVVNGYRSMFQFFFAESAKNYDEVMKADRDLYFRIFKRLMNHGVYVPPSQFETNFVSFAHSDDDISKTIEAFDLSVGEAAK

SEQ ID NO: 19857 - protein, 514 aa, Pseudoalteromonas tunicata D2
MTLKKKPLVLIILDGWGYREDPESNAILAANTPVMDKLWQTCPSTLISGSGLDVGLPPGQMGNSEVGHVNLGAGRIVYQDFTRITKSIADGDFFENPTFVNAIDQAVKNNKAVHLMGLLSPGGVHSHVDHILATIELAAKRGAKAVYLHAFLDGRDTAPRSAQESIDLVDKKFNELQCGRIASLIGRYYAMDRDNRWDRVEKAYNLMTQASAEYHFNDATSALKAAYNRNENDEFVAATSITPAKQDTAQINDGDAVLFLNFRADRARQMSRVFVDKNFDGFVKQKAPELAAFVTMTEYAKDIPAPSAFPSVALTNVLGEWLAKHNKTQLRISETEKYAHVTFFFSGGREALFEGEDRILIPSPQVATYDLQPEMNSEMLTDKLVEAIHAGQHDVIICNYPNGDMVGHSGVFSAAVKACEAVDHCIGRVIEALTQTGGEALITADHGNAEQMQNEETGQAHTAHTSEPVPFIYFGRQAQAYSDKKLSDVAPTMLHLLGMAQPEEMTGTTIMQVQ

SEQ ID NO: 19858 - protein, 449 aa, Desulfovibrio desulfuricans G20
MSTNYPVFNCKNGDDVIRAVKDYNVSFVQFWFVDILGNLKSFQVTPDELEAAFEEGMGFDGSSILGFTRIEESDMIAFPDASSFQICSWRPMDRPVARMFCDIRTPDGNPYEGDPRYVLRRLVDKAAQKGYTYYVGPELEFFLFADSTCPRPLDSGGYFDAPPLDLGNEVRRDIIFALQKMGIDVEYSHHEVAPSQHEIDLRYNEALKMADIAMTYKVVVKEIARKHGVYATFMPKPIFGENGSGMHVHQSLFKNGKNAFFDANDPHHLSAEARHYIAGLLTHASEITCITNQWVNSYKRLVPGYEAPVYIAWAQRNRSSLIRVPMYKPGKEAATRIELRNPDPACNPYLAFAAMLGAGLEGIEKGYEVPRAVEENIFAMEAEDLSAKGIDSLPGSLYEAAVALRDSALMKEVLGEHTHQNLVGNKLIEWDAYRTHVSEFELKRYLPVL

SEQ ID NO: 19859 - protein, 510 aa, Solanum tuberosum
MANIDIAGIMKDLPNDGRIPKTKIVCTLGPSSRTVPMLEKLLRAGMNVARFNFSHGTHEYHQETLDNLKIAMQNTQILCAVMLDTKGPEIRTGFLTDGKPIQLKEGQEITVSTDYTIKGNEEMISMSYKKLVMDLKPGNTILCADGTITLTVLSCDPPSGTVRCRCENTATLGERKNVNLPGVVVDLPTLTEKDKEDILEWGVPNNIDMIALSFVRKGSDLVNVRKVLGPHAKRIQLMSKVENQEGVINFDEILRETDSFMVARGDLGMEIPVEKIFLAQKMMIYKCNLAGKAVVTATQMLESMIKSPAPTRAEATDVANAVLDGTDCVMLSGESAAGAYPELAVKIMSRICIEAESSLDNEAIFKEMIRCTPLPMSPLESLASSAVRTANKARAKLIVVLTRGGSTAKLVAKYRPAVPILSVVVPVLTTDSFDWSISDETPARHSLVYRGLIPLLGEGSAKATDSESTEVILEAALKSAVTRGLCKPGDAVVALHRIGSASVIKICVVK

SEQ ID NO: 19860 - protein, 228 aa, uncultured cyanobacterium
HEVAGAGQHELGMKFAQLIEAADNVMIYKYVVRNVAKKYGKRPPFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKIATVPPSLNGALEALSADRAFLTEGGVFTD

SEQ ID NO: 19861 - protein, 216 aa, Saccharomyces cerevisiae
MIDRTKNESPAFEESPLTPNVSNLKPFPSQSNKISTPVTDHRRRRSSSVISHVEQETFEDENDQQMLPNMNATWVDQRGAWLIHIVVIVLLRLFYSLFGSTPKWTWTLTNMTYIIGFYIMFHLVKGTPFDFNGGAYDNLTMWEQINDETLYTPTRKFLLIVPIVLFLISNQYYRNDMTLFLSNLAVTVLIGVVPKLGITHRLRISIPGITGRAQIS

SEQ ID NO: 19862 - protein, 852 aa, Saccharomyces cerevisiae
MFKSKTSTLSYDETPNSNEGDRNATPVNPKEKSQTKHLNIPGDRSRHSSIADSKRSSSRYDGGYSADIIPAQLRFIDNIDYGTRLRKTLHRNSVVSNGYNKLSENDRWYFDLFDRKYFENYLEEPTYIKIFKKKEGLEQFDRMFLAQELKIPDVYKSTTYQGEPAVANSELFKNSICCCTFSHDGKYMVIGCKDGSLHLWKVINSPVKRSEMGRSEKSVSASRANSLKIQRHLASISSHNGSISSNDLKPSDQFEGPSKQLHLYAPVFYSDVFRVFMEHALDILDANWSKNGFLITASMDKTAKLWHPERKYSLKTFVHPDFVTSAIFFPNDDRFIITGCLDHRCRLWSILDNEVSYAFDCKDLITSLTLSPPGGEYTIIGTFNGYIYVLLTHGLKFVSSFHVSDKSTQGTTKNSFHPSSEYGKVQHGPRITGLQCFFSKVDKNLRLIVTTNDSKIQIFDLNEKKPLELFKGFQSGSSRHRGQFLMMKNEPVVFTGSDDHWFYTWKMQSFNLSAEMNCTAPHRKKRLSGSMSLKGLLRIVSNKSTNDECLTETSNQSSSHTFTNSSKNVLQTQTVGSQAIKNNHYISFHAHNSPVTCASIAPDVAIKNLSLSNDLIFELTSQYFKEMGQNYSESKETCDNKPNHPVTETGGFSSNLSNVVNNVGTILITTDSQGLIRVFRTDILPEIRKKIIEKFHEYNLFHLEAAGKINNHNNDSILENRMDERSSTEDNEFSTTPPSNTHNSRPSHDFCELHPNNSPVISGMPSRASAIFKNSIFNKSNGSFISLKSRSESTSSTVFGPHDIPRVSTTYPKLKCDVCNGSNFECASKNPIAGGDSGFTCADCGTILNNFR

SEQ ID NO: 19863 - protein, 71 aa, Glycine max
  misc_feature (50)..(50): Xaa can be any naturally occurring amino acid
  unsure (1)..(71): unsure at all Xaa locations
LCGAAVTTVNRAGACMVSPFTGGKSMAGFPTMNTNTDITFIVSNWGRVAXMQAWPPVGQKMFETLAYLPDL

SEQ ID NO: 19864 - protein, 401 aa, Magnetococcus sp. MC-1
MGILSNRVAKVKPSATLAVTAKAKELKAAGRDVIGLGSGEPDFDTPDHIKQAAIDALNAGYTKYVAVAGTPELRQAIADKYKRETGLDYSAEQTVVTVGGKQAFFNLAQATLNSGDEVIIPAPYWVSYPDMTLLADGTPVIVDTQESHGFKITPAELEAAITPRTKFVVLNSPSNPTGNAYSIAELHALAEVLRKHPHVWVISDDIYEKIIYDGFEFATMVKVAPDLQDRTVILNGVAKAYSMTGWRIGYAVGPLDVIKAMTKIQGQSTSNATSFAMKGALEAITGPQDCVEPMVKAFKERRDYVVARLNAMPGISCLTPEGAFYVYPNVAGLVGKKAPDGSDLKDSVDLASYMLEAEGVAVVPGVAFGLDPYLRLSYATSMEDLIKAMDRIEKIAQQLAG

SEQ ID NO: 19865 - protein, 570 aa, Candida albicans
MSEHKWWKEAVVYQIWPASYKDSNGDGVGDIPGIISTLDYIASLGVTTVWLSPMYDSPQDDMGYDVSDYENVYSKYGTLQDMDRLIAGCHDRGLKLILDLVINHTSVEHKWFKESRLSKDNPKRDWYIWKPPRIDSNGNKHPPNNWGSYFSGSAWKYDELTGEYYLHLFAESQPDLNWENKECREAIYNSAIKFWLDKGVDGFRIDTAGMYSKYQHFKDAPVAFPDTEFQPCEIYHKNGPRIHEFHKEMAKVMEPYDTMTVGEVGHSTREQALKYVSAAEKEMNMMFLFDVVELGSDPRDRFRYNGFDLVDLKKAIKSQGEFAEGTDAWSTVFIENHDQARAISRFGNDSPEFRVLSGKAIAMLQCCLTGTLFIYQGQEIGMTNVPRSWPIEEYKDINTINYYRAFKEKYGKDADYKQKEEKLVDVINRLARDNARTPVQWSHQQYAGFSEVEPWMRVNDNYKEINVEDQDGDDHSLLNFYRKLLKLRGEYKDLFVYGEMKFLDFDDKKLFTFAKEAPGSPVAYIVINFSGEDVKFEPLIKGNYKLVLTNVDKDSKDALSPYEARMYVVD

SEQ ID NO: 19866 - protein, 135 aa, Podospora anserina
MTGGGKSGGKASSGKNAQSRSSKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQNLLPKKTGTKPGKNASQEL

SEQ ID NO: 19867 - protein, 394 aa, Zea mays
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19868 - protein, 178 aa, Thermotoga sp. RQ2
MKGKEKIVMVTAYDAPSARIARDAGIDVILVGDSLGNNVVGYENTIPVTMEEMVIHVAAVKRGAPDAFIVADMPFLSYQTSVEKAVENAGKFLKVGANAVKIEGGEEFGELVQKLVESGIPVMGHIGLTPQFVNRFGGYRVQGKTEKNREYLLRSARELEKRGAFAIVLELVVEEVAK

SEQ ID NO: 19869 - protein, 394 aa, Zea mays
LGAERRARLPPGEMWWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGISGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19870 - protein, 394 aa, Zea mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYHGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19871 - protein, 394 aa, Zea mays
  misc_feature (166)..(166): Xaa can be any naturally occurring amino acid
  unsure (1)..(394): unsure at all Xaa locations
LGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDRTVTSSLRAWADHGASVEFLTEIRRMTFKIIVQIFLXGADQATTRALERSYTELNYRMRTMAIHMTDFAYRGALRARRRIVTVMQGVLDERRAARAKGVSGGGVDMMDRLIEAQDERGRRLDDDEIIDVLVMYLNAGHESSGHITMWATVFLQENPDMFARAKAEQEAIMRSILSSQRGLTLRDFSKMEYLSQVIDETLRLVNISFVSFRQATRDVFVHGYLIPKGWKVQLWYRSVHMDPQVYPDPTKLYPSRWEGHSPRPGTFL

SEQ ID NO: 19872 - protein, 437 aa, Corynebacterium efficiens YS-314
MTTKKRNTSETTDTAPKAVGADQAARPVRRTTRRIFDQSEKMKDVLYEIRGPVAAEAERMELDGHNILKLNTGNPAVFGFDAPDVIMRDMIAALPTSQGYSTSKGIIPARRAVVTRYEVIPDFPNFDVDDVFLGNGVSELITMTMQALLNDGDEVLIPAPDYPLWTAATSLSGGKPVHYLCDEDNEWNPSIEDIRSKITEKTKAIVVINPNNPTGAVYSRKVLQEIADIAREYDLLVLADEIYDRILYDDAQHINMATLCPDLMCITYNGLSKAYRVAGYRAGWMIITGPKRYAKGFIDGLELLAGTRLCPNVPAQHGIQVALGGRQSIYGLTGEGGRLLNQRNVAWQKLNEIPGVSCYKPMGALYAFPRLDPNVYEIHDDTQLMLDILRSEKILLVQGTGFNWPHHDHFRVVTLPWASQLENAIERLGNFLVSYKQ

SEQ ID NO: 19873 - protein, 429 aa, Ralstonia eutropha JMP134
MSRNQQLFDRAQQTIPGGVNSPVRAFRSVGGTPRFITCAEGAYMWDADGQRYIDYIGSWGPMIVGHAHPDVVRAVQETAAHSFSFGAPTEAEIDMAEEICKLVPSIEQVRLVSSGTEATMSALRLARGFTGRDLIIKFEGCYHGHADSLLVKAGSGLLTFADTTQNAPSSAGVPADVTRHTMVLEYNNVAQLEEAFAQHRGEIAAVIVEVVAGNMNLVRASDAFLKAMRELCTRDGAVLIFDEVMTGFRVALGGAQSHYGITPDMTCLGKVIGGGMPAAAFGGRRDIMAKLAPLGGVYQAGTLSGNPLAVAAGLTTLRLIQAPGFYDKLTAQTRKLADGLSEAARAAGVPFAADAIGGMFGIYFRDGVPGSFAEVTKSDTARFNRFFHAMLDNGVYLAPSAFEAGFVSACHDDAILQATLDAARKAFAA

SEQ ID NO: 19874 - protein, 785 aa, Zea mays
MEASSSLRFQVSRFSSFKIWLCLFLVLVLQNCSPALSDSPYLVGMGSYDITGPAADVNMMGYANAEQIASGIHFRLKARAFIVAEPNGKRVVFVNLDACMASQLVTIKVLERLKARYGDLYNENNVAISGIHTHAGPGGYLQYVVYIVTSLGFVRQSFDVIVNGIEQCIVEAHNNLHPGKIYVNKGDLLDASVNRSPSAYLNNPAEERGKYKYNVDKEMTLIKFVDDESGPIGSFNWFATHGTSMSRTNSLISGDNKGAAARFMEDWAEQNGIPKQAAHVNHDGLESSHMTSRLPRRVSPIIPEPNEITDDLVQLASSYEASGGRRLSSSSITKRIRSTQQNRPKFVSAFCQSNCGDVSPNVLGTFCIDTGLPCDFNHSTCNGKNELCYGRGPGYPDEFESTHIIGNRQFQKAVDLFSSASEEIQGKIDYRHTYLDFSKLEVNVRTSTGSQQVVKTCPAAMGFAFAAGTTDGPGAFDFKQGDVKGNPFWRLVRNLLKTPGKEQVECQAPKPILLDTGEMKEPYDWAPAILPIQIIRIGQLAILCVPGEFTTMAGRRLRDAVKAVLTSDNSGEFNNIHVVLAGLTNTYSQYITTFEEYEIQRYEGASTLYGPHTLSAYIQEFQKLATAMVANKEVPTNFQPPDMLDKQIGLLPGVVFDSTPPGVEFGDVSSDVPASSTFRKGSVVNATFYSACPRNDLLTDGTFALVEKLDGSNSWVPAYDDDDWSLRFKWSRPSKLSPRSFATLEWTVPGDAPSGVYRLRHFGASKPLIGSIKHFTGTSRAFAVR

SEQ ID NO: 19875 - protein, 482 aa, Salmonella enterica subsp. indica
MSDVPLIAVVMAGGTGSRLWPLSRELYPKQFLQLSGKNSLLQTTLLRLSALACNEPLVITNEQHRFIVAEQLRQIDQLHNNIILEPYGRNTAPAIALAALSALKRKEQEDPLLLVLAADHIIAKEKVFCNAVKKAVPIAENGNIVTFGIIPEYAETGYGYIERGAPFSVNANSTETDFYHVKNFVEKPDRLKAEKYISTGDYFWNSGIFMFKATVYLNELKKFRPDIYSICEQVLSSSYRDLDFIRLPETLFKDCPAESIDFAVMEKTERCIVCPVDIGWSDVGSWQSLWDISEKTDEGDVCKGDILTYNTKNNYIYSESALVAAVGVEDIVIVQTKDAILVSKKSDVQDVKKIVEMLKAQERTEYIAHREVFRPWGKFDSIDQGKRYKVKKIIVKPGEGLSLRMHHHRSEHWIVLSGTAKVTLDDKTMLVTANESIYIPLGATYSLENPGVIPLNLIEVSSGDYLGEDDIVRQKERYRKDD

SEQ ID NO: 19876 - protein, 396 aa, Glycine max
LKGTISGRSSLKIIEPLKEQRNRESTRCECKAYLRISLQKSHDIFPSEWRVTKFVVEHNHVLLTQSEVRFLPANRTISEDDIERIFLLKEGGLSVRQLMRVIELEKNVKHGYLPFIERDIRNLFVKTKKKVERNDAKDLLKYCEDAKKSCSKFQYAYTLDEERRLEHIFWSPASCSDWYQKYGDVVVFDTTYKVNSYEMPFGIFVGMNSHGKTVLFGCALLRNETISAFRWLMKTFISLMKKPPKTILTDQDPWMKEAISKDLPSTKHSFCIWHITFKFSSWFNAILRDKYSKWCSDFYELYKLETCEEFEHQWPKVVAKYNLHSNKHVKGLYEIRNYWALAYLRDHFFGGMTTTGRSESINAFIKRFINSHTSLSDFTKQVDVAIDDIKQKKKKK

SEQ ID NO: 19877 - protein, 482 aa, Salmonella enterica subsp. salamae
MSDVPLIAVVMAGGTGSRLWPLSRELYPKQFLQLSGEHSLLQTTLLRLSALACKDPLVITNEQHRFIVAEQLRQIDQLHDNIILEPCGRNTAPAIALAAFSALKRNEQEDPLLLVLAADHVIAKENVFCSAIKKAVPIAENGNIVTFGIIPEYAETGYGYIERGAPISVNGNSTEIDFYHVKNFVEKPDRLTAEKYISTGNYFWNSGMFMFKATVYLNELKKFRPDIYNVCEQVVSSSYRDLDFIRIPETLFKDCPAESIDFAVMEKTEHYIVCPINIGWSDVGSWQSLWDISEKTDEGDVCKGDILTYNTKNNYIYSESALVAAVGVEDIVIVQTKDAILVSKKSDVQDVKKIVEMLKTQDRTEYIAHREVFRPWGKFDSIDQGERYRVKKIIVKPGEGLSLRMHHHRSEHWIVLSGTAKVTLDDKTMLVTANESIYIPLGATYSLENPGVIPLNLIEVSSGDYLGEDDIVRQKERYKKDN

SEQ ID NO: 19878 - protein, 277 aa, Solibacter usitatus Ellin6076
MSDITTKVREHYSATDLIDRIKSALAKSVAGRHGASDAAACVAQLAPLDQFHTRGILATAELAGAAGVERSTRVLDVGCGIGGPARYLAATFECKVTGLDLSAGFIDAASYLTARCGLSDRVTFQVGDGHHLPFEDAGFDAVFLQHVAMNVEDRAGLYAEVRRMLPVGGRFATYDLVLRDGDVVYPVPWARDASTSFLLSEGDTRTALEQAGFKAVVWQDDTQTALDWFEAAVGGSRPGGLNLGVVMGPDFPALTANLARNLRENRLGVLSAVLTRD

SEQ ID NO: 19879 - protein, 475 aa, Rickettsia montanensis
MNLLKNITGKNYINGEFIEFGKQISVINPATLKEIATVPNLGLSEINSAINNTVTSFSSWSQSSFEARIAILRRWYNLVIENIEELSHILTLEQGKVLAESKKEILYGVSFIDWYTYAIHNIHSTIKPGNSKAHKIVTQYEPVGPSAAITPWNFPNAMITRKVVPAIAAGCSVILKPSSLTPLSALVLAKFASDAGLPAGVFNVITGSSDIIGKAFCEDFRLRKLSFTGSTNVGKILYQNAANTLKRLSLELGGNAPFIITADNNLEKVVSDLITAKTRNSGQSCISPNRIFIEESIYEKFIEILKAKFTKLKAGDGFDKESDVGPLINSAAIEKIQKLLADAQSKGAKLICGGKAVDNFIEPTIIIDCLDNMDIFRTEIFGPVVACYKFKDLDEVIERANNTEYGLQGYVYSNNISVVQMIASKLDFGMVSINDPLPANAKAPFAGRKASGFGVEGSFEGIFEYLNTKYINLQH

SEQ ID NO: 19880 - protein, 474 aa, Salmonella enterica subsp. salamae
MNYIQPVILCGGNGTRLWPLSRELFPKQFLNINASESMLQRTLSRLEGLPVGAPVLICNEKHRFITAEQIRATNRKPESIILEPFGRNTAPAIALAALKNIEDAKDPLMLILAADHVFNDETSFRRAIMSACYYAESDKLVTFGIVPTKPETGYGYIKRGDSVNTCSSYLAFNVSAFVEKPDIEKAATYVSSQEYYWNSGMFLFKASKYIEELKKFRPDIIEACTKALALSHADLDFIRIDQQAFQTCPSDSIDYAVMEKTSDAIVVPMDAGWSDVGSWSSVWDVAVKNIENNVINGDVVALDTVNSYLHADGCLLTTIGINDLVIVCTKDAVLVAERNASQNVKNIVDTLKRNGRYEHQKHREVYRPWGKYDSIDSSERYQVKRITVKPGEGLSLQMHYHRAEHWIVVAGTARVTINDEVRLLGENESIYIPIGAKHCLENPGKIALELIEVRSGAYLEEDDIIRFADKYGRV

SEQ ID NO: 19881 - protein, 475 aa, Rickettsia rickettsii
MNLLKNITGKNYINGEFIEFGKQISVINPATLKEIATVPNLGLSEINSAINNTVTSFALWSQSSFEARIAILRRWYNLVIENIEELSHILTLEQGKVLAESKKEILYGASFIDWYTYAIHNIHSTIKPGNSNTHKIVTQFEPVGPSAAITPWNFPNAMIARKVVPAIAAGCSVILKPSSLTPLSALVLAKFASDAGLPSGVFNVITGSSDIIGKAFCEDFRLRKLSFTGATNVGKILYQNAANTLKRLSLELGGNAPFIITADNNLEKVVSDLVIAKTRNSGQSCTSPNRIFIEESIYEKFIEILKAKFTKLKAGDGFDKESDVGPLINSAAIEKIQKLLADAQSKGAKLICGGKTVDNFIEPTIIIDCLDNMDIFRIEIFGPVVACYKFKDLDEVIEHANNTEYGLQGYVYSNNISVAQMIASKLDFGMVSINDPLPANAKAPFAGRKASGFGVEGSFEGIFEYLNTKYINLQN

SEQ ID NO: 19882 - protein, 502 aa, Rhodococcus sp. RHA1
MTESVSQGASSRAKTNRSLQGASGDDVGYRKSLKPRHIQMIAVGGAIGTGLFMGAGGRLSASGPSLVLVYALCGFVAFLVLRALGELVLYRPSSGSFISYAREFYGEKMAFVVGWLYFLMWAMASIVDVTAIALYLKFWAPAVPLIDAAPQWTLALVALFVVTLLNLVSVKLFGEMEFWFAIIKVTALVAFLVFGTLFLVLNGETDLGATGFSIVLDHGGVFPTGAITPILAAGGVIFAYASVELVGIAAGETENPSRIIPKAINTVIIRILLFYVGSVLLLSLLLPFGAYTAQTSPFVTFFSHIGSPETAAVASSVMNFVVLTAALSSLNAGLYATGRVLRSMALNGSAPSFTSKLSGNGVPFGGILLTVGCALLGVGLNAIVPTKAFEIVLEISALGIIAAWGTIMLCQLKLRKWANEGRVERPSFRLFGAPFTSYFVLAFLAFVLVTMGFSETGQWVLGSLVVIVPLLIVGWRRSRARLSTTTDHRDFVPVEIPPRTSH

SEQ ID NO: 19883 - protein, 264 aa, Colwellia psychrerythraea 34H
MAKITTASLLNMKQQGKKISTITAYDASFAKLFDQAGIHAILIGDSLGMVLQGQDSTLPVTIEDMAYHTRCVKRGVEETLIIADMPFMSYANEEQALANAALLMQAGASMVKIEGGAWLNGTISALVERGVPVCAHLGLTPQSVNIFGGFKVQGRDDDKAQQMIADAKALEAAGAQLLVLECIPAILGEAITQALTIPTIGIGAGKDTDGQILVMHDALGIACNYMPKFSRNFLKDTGDIKKAVELYISEVSEGNFPGDEHIFK

SEQ ID NO: 19884 - protein, 460 aa, Cryptococcus neoformans var. neoformans JEC21
MPRISVPAFAKTVSSRLNFTSTRTLLYTRRMSTTPNAVIPQAKRMFDGATHKLDVWSIFTPANVPADCINLGQGFMNWAPPDWIRAESHESMDHDIMSNHYSHPRGRPRLLKAISKHYSPQFENIVARGKDLTNEEILVTSGANCGMFAALTAHCEPGDEVICIEPYFDQYFASIHFQGAKPVFVPLHPPTGKGIKHGGDWTLNIDEFAAAFTPKTKAVIINTPHNPVGKVFTKEELEQIAKVCIEKNVLVLADEVYDCMVYDGNKHFRIATLPGMWERTLTVGSGGKSFACTGWRVGWLIGPPQLTAATLAAHSRIVFCTNSPMQEAVAIGLEKAAEHKFFEEQVAAYEERRDILCSYFDQIGLSYTKPEGSYFLLVDISPVKVPEGYPIVETCKGRGKDFEFCWWLCQELKVVGIPPSEFYSEEHVNIGERFARFAFCKDPELLHAAGKRLLKLKEYL

SEQ ID NO: 19885 - protein, 228 aa, uncultured cyanobacterium
HEVAGAGQHELGMKFAQLIEAADNVMTYKYVVRNVAKKYGKTATFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKIATVPPSLNGALEALNADRAFLTEGGVFTD

SEQ ID NO: 19886 - protein, 483 aa, Oryza sativa (japonica cultivar-group)
MAASGWWCGLSLCAKPKQVASESVHGAQLALQRLTAARRCGGGGDAACVDVEAGKPCKCGEEHTEAAAAGRVAAVEAVHHGKPTSSFAHSVINMVGMLIGLGQLSTPYALENGGWASVFLLVGLGVMCAYTAHLIGKCLDDDPASKTYQDIGERAFGGKGRVVASAFIYLEIFFALVSYTISLSDNLPLVFAGAASHLHLPWVRLTATQLLTVAAVLVALPSLWLRDLSTISFLSFAGIVMSLLIFGTVVCAAAFGGVGLGGYIPALRLERIPAVSGLYMFSYAGHIVFPNIHAAMKDPSAFTRVSVASFAVVTALYTALAFVGASMFGPSVSSQITLSMPPGLAVTRIALWATVLTPVTKYALEFAPFAIQLERHLPAAMSPRARTLVRGGVGSAALLLILALALSVPYFQYVLSLTGSLVSVAISIIFPCAFYLKIRWGRVSRPAVALNAAMIAAGVVLAVVGTASSATSLVQSIQKGHAA

SEQ ID NO: 19887 - protein, 228 aa, uncultured cyanobacterium
HEVAGAGQHELGMKFAQLIEAADNVMTYKYVVRNVAKKYGKTATFMPKPVFNDNGTGMHVHQSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAGELQKIATVPPSLNGALEALNADRAFLTEGGVFTD

SEQ ID NO: 19888 - protein, 554 aa, Candida albicans SC5314
MGSSTNNTQSKATPSVLENEVNSSKSSVVSSTSSAKGLLRETTNHGTMETSSVQISESESRPSKMVLVLTLASSISGFMFGYDTGYISSALVQIGTDLSNKILTSGEKEFITSATSLGALLGAVVGGVLANLIGRRRVLLGSNIIFVVGTIIQLAARTVWTMIAGRFVLGWGVGIASLIAPLMISELAPAKYRGRLIVTNVIFITGGQLIAYFINWGLTRVSHGWRVSVGLCMVPPVLQFVLFWFLPDTPRFYVMNGNFEKARQVLRKVHVDPSDEFVNATIDEMIASDSTVPGNGPLQKAWKSIKIIHTTPGNFRALILACGLQGIQQFTGFNSLMYFSATIFETIGFHNATAVSIIIAATNFVFTGIAICIIDKVGRRRILLVGMPCMCISLIVCAVAFHYLNVDFSTGTVVSRGINGWGIVVIIGMILYVASYAIGIGNAAWVGVELFSDVNVRSIGAMYAACTNWAGSLVIASTFLTMLENITPTGTFSFFAGLCFIAFFFVYFLLPDTAGLELEETTDFLSNGFNVKQAAQLSKERKKHSKFAKSKPTV

SEQ ID NO: 19889 - protein, 99 aa, Triticum aestivum
  misc_feature (60)..(60): Xaa can be any naturally occurring amino acid
  unsure (1)..(99): unsure at all Xaa locations
MASGGGKATASSWAAAMSMGAGTVEALKERHAGLCRWNYHALRCVQQRAGTAAAGNGKTXGGARCWRGGGQEEEPRKARQEQEEELRTVMYLSNWGPNN

SEQ ID NO: 19890 - protein, 259 aa, Mycoplasma genitalium G37
MNSFFPSRKLGQNFTVNLSVIKRIFAFVKNLNPQAIVEIGVGKGALTNYLLKLKIPYKGIEIDKRLIEYLLVEKILTEDQLVKGDILKKDFNSFFENLSPLLCGNIPYSITSPIINKFLESKLRSFVLMTQKEFANRLLAKVNSSDYSAFGAFCQYYLTITTVFKIDRHAFKPKPKVDSTLILLEKNKSVSYDFKFGLFLKQCFNQRRKMLINNLKHFFAVDYLLNIIQKQNLKTSIRAQELSPCQLFNLYQNICNGKN

SEQ ID NO: 19891 - protein, 464 aa, Sulfitobacter sp. EE-36
MPSTVKKQPRKAAAKKPAKSSVVPDMLDANVSVETNAQLIARREQAVPRGVASAAPIYAKYAENAELWDVDGNRYIDFVGGIGVLNTGHRHPKVIAAAKAQEDQYTHTSFQVVPYAPYIELAEKLNALAPGDAPKKTLLVTTGAEAVENAVKIARAATGRPGVIAFTGGYHGRTLLTLGMTGKISPYKKDVGPFPSDIFRAPFPSPRDGITVEDAITGLKNLFLTDAQPERVAAIIIEPVLGEGGYTPVPFEMMHQLREICDQHGIMLIADEVQAGFGRTGKWFAIEHSGVTPDLITVAKSMAGGYPLAGVIGRADVMDAMIPGGLGGTYGGNPVACAAALAAIEAIEEEGLLQRSLDMGDHLKARFAEIGARSAPFRMWDIRGLGAMVAVEFVTDFDTATPDGDFTKRVIAHALKRGLLLLSCGMQGNAVRVMVPLTASDAIIEEGLGIFEASVAAAVAEEAK

SEQ ID NO: 19892 - protein, 134 aa, Brassica napus
MAETTSWIPVWFPLMVLGCFSLKWLAKKVNVWLYESSLGENKHYLPPGDLGWPFIGNMPSFLRAFKTSDPDSFARTLVQRYGPKGVYKTHMFGNPSIIVTTPDTCRRVLTDDDAFRPGWPTSTMELIGRKSFIG

SEQ ID NO: 19893 - protein, 160 aa, Glycine max
  misc_feature (128)..(128): Xaa can be any naturally occurring amino acid
  unsure (1)..(160): unsure at all Xaa locations
MGDFNLALVIVAVVVCVIVFLVNVYLLVNYQHPDDANQAYFPKFVVVLGLSVAAISILMLPADVANRQACRHAIYNGACSLTLPMKDLWLAVYILDAVLVFFVIPFAMFFYEGDQDMSVGKRIKSALXWMVTTAIVCALVLGILYGLVGKVGLTVRHLSS

SEQ ID NO: 19894 - protein, 526 aa, Mannheimia succiniciproducens MBEL55E
MIISIALLTISAYNTAQFFLHGCFLVFSSNMKKGYLNQTNKIFTEYLMSRRLRRTKIVCTMGPATDKGNNLEKIIAAGANVVRMNFSHGTPEDHIGRAEKVREIAHKLGKHVAILGDLQGPKIRVSTFKEGKIFLNIGDKFILDAEMPKGEGNQEAVGLDYKTLPQDVVPGDILLLDDGRVQLKVLATEGAKVFTEVTVGGPLSNNKGINKLGGGLSADALTEKDKADIITAARIGVDYLAVSFPRSSADLNYARQLAKDAGLDAKIVAKVERAETVETDEAMDDIINAADVIMVARGDLGVEIGDPELVGVQKKLIRRSRQLNRVVITATQMMESMISNPMPTRAEVMDVANAVLDGTDAVMLSAETAAGQYPAETVAAMAKVALGAEKMPSINVSKHRMNVQFESIEESVAMSAMYAANHMRGVAAIITLTSSGRTARLMSRISSGLPIFALSRNESTLNLCALYRGVTPVHFDKDSRTSEGAKAAVQLLKDEGFLVSGDLVLLTQGDASSSSGTNLCRTLIVE

SEQ ID NO: 19895 - protein, 473 aa, Salmonella enterica subsp. indica
MIPVILAGGTGSRLWPLSRELFPKQFLKLSSELTMLQATFARLNDLNYKNSIVICNEAHRFIVAEQLREIGKLSNNIILEPHGRNTAPAITLAALAVKQRFPDKDPLILILAADHIIKDDRIFCNLIKKAAPLANKGKFVTFGIVPFKPETGYGYIRRGDAVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLIGENESIYIPLGATHCLENPGKIPLDLIEVRSGSYLEEDDVVRFEDRYGRV

SEQ ID NO: 19896 - protein, 461 aa, Streptomyces coelicolor A3(2)
MSNSTTAKAPRQPADASLSHGLKQRHLSMIALGGVIGAGLFVGSGAGIAAAGPSIVVAYTVSGLLVMLVMRMLGEMSAAYPSSGSFSAHAERAIGPWAGFTAGWAFWVLLCTAVGLEGIGAAQIVHGWLPGTPEWAWVALFMVVFCGTNLAAVKNFGEFEFWFAALKVGAISLFLVLGVLAICGVLPGTDSPGTSHLGDFLPHGGNGLIIGLLASVFAYGGLETVTIAAAESENPVRGVASAVRTAMWRIALFYIGSMAVIVTLVPWDSPEVVEKGPYVAALDELGIPGAGQLMNIVVLVALLSAMNANIYGASRIGYSLVERGQGPKVLGRVSGGVPRVAVLVSSLFGFGCVLLSYWRPDDVFSWLLNMIGAVILVVWIFIAAAQLRLRRRLEREAPEKLVVRMWAFPWLTWVALAGMAAVFVLMAREPDTRVQLYSTGGMTLVLAAVGYARQRRGAARD

SEQ ID NO: 19897 - protein, 223 aa, Neisseria meningitidis MC58
MTTQDELKRIAAEKAVEFVPENEYIGIGTGSTINFFIEALGKSGKKIKGAVSTSKKSGELLAQYDIPVVSLNEVSGLAVYIDGADEVNHALQMIKGGGGAHLNEKIVASASEKFICIADESKYVSRLGKFPLPVEVVESARSLVSRKLLAMGGQPELRIGYTTFYGNQIVDVHGLNIDQPLTMEDEINKITGVLENGIFARDAADVLILGTEEGAKVIYPCQG

SEQ ID NO: 19898 - protein, 478 aa, Salmonella enterica subsp. enterica
MAAETLIPVIMAGGTGSRLWPLSRELYPKQFLCLQNNLSMLQSTISRLDGIKHASPIVICNEKHRFIVADQLLQMNQLTNNIILEPVGRNTAPAVALAALVAKNNSSKEDPLLLILAADHVFTNENEFRITVSKAIPFADRGKLVTFGIVPSKAESGYGYILRGNKLQLEDDIIAFDVEQFVEKPSIETAQAYVASGDYYWNSGMFLFRAGRYLEELKKYRPDILIACEKSISDLNIDLNFVRINEDDFYPCPDVSIDYAVMEHTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFRDRYGRK

SEQ ID NO: 19899 - protein, 431 aa, Zea mays
MATTTTTILLLLLVAATAVSAADLSVYHNVHPPSPSPLESIIALARADDARLLFLSSKAASSGGVTSAPVASGQTPPSYVVRAGLGTPVQQLLLALDTSADATWSHCAPCDTCPAGSRFIPASSSSYASLPCASDWCPLFEGQPCPANQDASAPLPACAFSKPFADTSFQASLGSDTLRLGKDAIAGYAFGCVGAVAGPTTNLPKQGLLGLGRGPMSLLSQTGSRYNGVFSYCLPSYRSYYFSGSLRLGAAGQPRNVRYTPLLTNPHRPSLYYVNVTGLSVGRTWVKVPAGSFVFDPATGAGTVIDSGTVITRWTAPVYAALREEFRRQVAAPSGYTSLGAFDTCFNTDEVAAGGAPPVTLHMDGGVDLTLPMENTLIHSSATPLACLAMAEAPQNVNAVVNVVANLQQQNVRVVVDVAGSRVGFAREPCN

SEQ ID NO: 19900 - protein, 90 aa, Zea mays
  misc_feature (50)..(50): Xaa can be any naturally occurring amino acid
  unsure (1)..(90): unsure at all Xaa locations
MAAAKASSWMVAMSVGAVEALKDQGGLCRWNYALWSVYRTAKANVRSSRXSSCSGTWTWPRRRSKGRQEDKAAAEEGLRTVMYLSCWGPN

SEQ ID NO: 19901 - protein, 543 aa, Exiguobacterium sibiricum 255-15
MTCGELSFTTVEWGASFYYVAFSSSFWKVRALFVFSKSVLSKNLNKREANEMNTLQPQRKLDSTEEGLKRGLQARHMSMIAIGGAIGTGLFIASGASVAAAGPGGALLSYAIVGLMVYFLMTSLGEMAAYMPVAGSFSTYGAKFVDPSFGFALGWNYWYNWAVTIAVELVAAQIVMSYWFPDVPGFYFSALFLLLMIGLNYFSVKGFGEAEYWFAMIKVVTVIIFLIVGVAMIFGVFTSEAPVGFKNFALGDAPFVGGIPAVIGIILVAGFSFQGTELVGIAAGESEDPKKNVPKAVKQVFWRILLFYVFAIFVIGMLIPYTSPNLVSNDITDVAVSPFTLVFEKAGLAFSAALMNAVILTSVLSAGNSGMYASTRMLYTLARQGDAPKLFAQVSKNGVPRNALLATGAIGALCFLTSMFGGQVYLWLLNASGMTGFIAWLGIAISHYRFRKGFLAQGHSLSDLPYVAPAFPFGPLFAFGLCFLVIVGQNYAAFLADQIDWVGIAATYVGIPLFLAFWLGHKFKNRTSVVPYEEMEFPEHPRP

SEQ ID NO: 19902 - protein, 1061 aa, Oryza sativa (japonica cultivar-group)
MASCRRPAPLRLVVFLAIVLLRWSTNGNATAGGDDALRGDALALVRLRASLRCHAHALRDWSAGNVAAVCAWTGVRCAGGRVVSVDVANMNVSTGAPVSAAVAGLDALANLSLAGNGIVGAVTASALPALRFVNVSGNQLGGGLDGWDFASLPSLEVFDAYDNNFSSPLPAGVVALRRLRYLDLGGNFFSGEIPAAYGGMAALEYLSLNGNNLQGAIPPELGNLTSLRELYLGYYNVFDGGIPPELGRLRNLTMLDISNCGLSGRIPPELGALAALDTLFLHTNQLSGAIPPELGNLTALTALDLSNNALTGEVPATLASLTSLRLLNLFLNRLHGPVPDFVAALPRLETVQLFMNNLTGRVPAGLGANAALRLVDISSNRLTGMVPEMLCASGELHTAILMNNFLFGPIPASLGSCSSLTRVRLGQNYLNGTIPAGLLYLPRLNLLELQNNLLSGDVPANPSPAMAAASQSSQLAQLNLSSNQLSGPLPSSIANLTALQTLLVSNNRLAGAVPPEVGELRRLVKLDLSGNALSGTIPAAIGRCGELTYLDLSKNNLSGAIPEAIAGVRVLNYLNLSRNQLEEAIPAAIGAMSSLTAADFSYNDLSGELPDAGQLGYLNATAFAGNPRLCGPLLGRPCGYGGGGAAAVGAGGSSSAPVVTTRQRAAGGDFKLVLALGLLVCSVVFAAAAVLRARSCRGGGGPDGGGAWRFTAFHKVDFGIAEVIESMKDGNVVGRGGAGVVYVGRTRSGGSIAVKRLNTSSSAAAAGGGEAARHDHGFRAEIRTLGSIRHRNIVRLLAFCSRRGGSGGGEAASSSNVLVYEYMANGSLGEVLHGKGGGFLSWDRRYRIAVEAARGLCYLHHDCSPMIVHRDVKSNNILLGDNFEAHVADFGLAKFLRSGGGATASSECMSAVAGSYGYIAPEYAYTLRVDEKSDVYSYGVVLLELITGRRPVGDFGEGVDIVQWTKRVTDGRRESVHRIIDRRISTVPMDEVAHIFFVSMLCVQENSVERPTMREVVQMLSEFPRHGSDQPSPSSSAPETGEESSPEKEPNCYKLFPDLLT

SEQ ID NO: 19903 - protein, 206 aa, Brucella suis 1330
MSRTLVLVRHGQSEWNLKNLFTGWRDPGLTEQGHAEAKAAGQRLKAAGLKFDIAYTSALSRAQVTCQHILDELGQPGLETIRDQALNERDYGDLSGLNKDDARAKWGEEQVHIWRRSYDVPPPGGESLKDTGARVWPYYLHTIQPHVLREETVLVAAHGNSLRALIMALDGLTPEQILKQELNTGVPIIYRLNADSTVASKEILSA

SEQ ID NO: 19904 - protein, 228 aa, uncultured cyanobacterium
HEVAGAGQHELGMKFAQLIEAADNVMTYKYVVRNVAKKYGKTATFMPKPVFNDNGTGMHVHHSLWKGGEPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELSAEELQKISTVPPSLNGALEALSADRAFLTEGGVFTD

SEQ ID NO: 19905 - protein, 228 aa, uncultured cyanobacterium
HEVAGAGQHELGMKFAQLIEAADNGMTYKYVVRNVAKKYGKTATFMPKPVFKDNGTGMHVHQSLWKGGEPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADQLAQIATVPASLNGALEALNADKHYLMEGGVFSE

SEQ ID NO: 19906 - protein, 412 aa, Streptococcus pyogenes SSI-1
MEYEVYETMKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISISLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 19907 - protein, 346 aa, Trichodesmium erythraeum IMS101
MSPYLEELKVTAQAMVAKGKGILAMDESNGTCNKRFEKLGIPTTEEYRQAYRQLILTTPDLSNYISGPILYDETIRQSTTEGVPFLKVITDAGMIPGIKVDTGAKNLANHPNEKVTEGLDGLGERIAEYYQMGARFAKWRAVITIGDGIPSRACIEANAHGLARYAALCQEGGLVPIVEPEVLIDGNHTLERCFEVTDETLHTVFNHLYTQGVAFDQMILKPSMVIPGKDCPTQVSVEAVAEATINCLLKNVPVTVAGIAFLSGGQSIEQSSAHLNAMNALFGSRCPWPVTFSYARAIQQPALDYWSGDSARVAEAQQKLLARAKCNSAASVGEYSASMDETPVLV

SEQ ID NO: 19908 - protein, 228 aa, uncultured cyanobacterium
HEVAGAGQHELGMKFAKLIQAADNVMTYKYVVRNVAKKYGKTATFMPKPVFNDNGTGMHVHQSFWKGGQPFFFSEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 19909 - protein, 228 aa, uncultured cyanobacterium
HEVAGAGQHELGMKFAELIQAADNVMTYKYVVRNVAKKYGKTATFMPKPVFNDNGTGMHVHQSFWKGGQPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 19910 - protein, 259 aa, Leifsonia xyli subsp. xyli
MRRVPLIAGNWKMNLDHLQSIAVVQKLAWTLKDAGHDFGAVEVAVFPPFTDLRSVQTLVAADKLPIAFGGQDVSEHDSGAYTGEIAASFLAALEARYVIIGHSERRTLHNETDEQVAAKTAQAVKNGISPIVCVGETAEDLEKHGASAVPVAQLRAALAGIDSAADFVVAYEPVWAIGSGQAATPEQAEQVAAALRAVIAEALGDEVAAKTRILYGGSVKSGNIAGFMRETNVDGALVGGASLDVAEFAAIIRYQKHVI

SEQ ID NO: 19911 - protein, 1518 aa, Saccharomyces cerevisiae
MTGHVSKTSHVPKGRPSSLAKKAAKRAMAKVNSNPKRASGHLERVVQSVNDATKRLSQPDSTVSVATKSSKRKSRDTVGPWKLGKTLGKGSSGRVRLAKNMETGQLAAIKIVPKKKAFVHCSNNGTVPNSYSSSMVTSNVSSPSIASREHSNHSQTNPYGIEREIVIMKLISHTNVMALFEVWENKSELYLVLEYVDGGELFDYLVSKGKLPEREAIHYFKQIVEGVSYCHSFNICHRDLKPENLLLDKKNRRIKIADFGMAALELPNKLLKTSCGSPHYASPEIVMGRPYHGGPSDVWSCGIVLFALLTGHLPFNDDNIKKLLLKVQSGKYQMPSNLSSEARDLISKILVIDPEKRITTQEILKHPLIKKYDDLPVNKVLRKMRKDNMARGKSNSDLHLLNNVSPSIVTLHSKGEIDESILRSLQILWHGVSRELITAKLLQKPMSEEKLFYSLLLQYKQRHSISLSSSSENKKSATESSVNEPRIEYASKTANNTGLRSENNDVKTLHSLEIHSEDTSTVNQNNAITGVNTEINAPVLAQKSQFSINTLSQPESDKAEAEAVTLPPAIPIFNASSSRIFRNSYTSISSRSRRSLRLSNSRLSLSASTSRETVHDNEMPLPQLPKSPSRYSLSRRAIHASPSTKSIHKSLSRKNIAATVAARRTLQNSASKRSLYSLQSISKRSLNLNDLLVFDDPLPSKKPASENVNKSEPHSLESDSDFEILCDQILFGNALDRILEEEEDNEKERDTQRQRQNDTKSSADTFTISGVSTNKENEGPEYPTKIEKNQFNMSYKPSENMSGLSSFPIFEKENTLSSSYLEEQKPKRAALSDITNSFNKMNKQEGMRIEKKIQREQLQKKNDRPSPLKPIQHQELRVNSLPNDQGKPSLSLDPRRNISQPVNSKVESLLQGLKFKKEPASHWTHERGSLFMSEHVEDEKPVKASDVSIESSYVPLTTVATSSRDPSVLAESSTIQKPMLSLPSSFLNTSMTFKNLSQILADDGDDKHLSVPQNQSRSVAMSHPLRKQSAKISLTPRSNLNANLSVKRNQGSPGSYLSNDLDGISDMTFAMEIPTNTFTAQAIQLMNNDTDNNKINTSPKASSFTKEKVIKSAAYISKEKEPDNSDTNYIPDYTIPNTYDEKAINIFEDAPSDEGSLNTSSSESDSRASVHRKAVSIDTMATTNVLTPATNVRVSLYWNNNSSGIPRETTEEILSKLRLSPENPSNTHMQKRFSSTRGSRDSNALGISQSLQSMFKDLEEDQDGHTSQADILESSMSYSKRRPSEESVNPKQRVTMLFDEEEEESKKVGGGKIKEEHTKLDNKISEESSQLVLPVVEKKENANNTENNYSKIPKPSTIKVTKDTAMESNTQTHTKKPILKSVQNVEVEEAPSSDKKNWFVKLFQNFSSHNNATKASKNHVTNISFDDAHMLTLNEFNKNSIDYQLKNLDHKFGRKVVEYDCKFVKGNFKFKIKITSTPNASSVITVKKRSKHSNTSSNKAFEKFNDDVERVIRNAGRS

SEQ ID NO: 19912 - protein, 228 aa, uncultured cyanobacterium
HEVAGAGQHELGMKFAKLIQAADNVMTYKYVVRNVAKKYGKTATFMPKPVFNDNGTGMHVHQSLWKGGQPLFFGEGTYANLSQTARWYIGGILKHAPSFLAFTNPTTNSYKRLVPGFEAPVNLVYSEGNCSAAVRIPLTGPSPKAKRLEFRSGDALANPYLAFSAMMMAGLDGIKNQIDPGDGVDVDLFELPADELAQIATVPASLNGALEALNADKHYLMEGGVFSE

SEQ ID NO: 19913 - protein, 236 aa, Burkholderia sp. 383
MSLMSISSAPADAFADLPLLDSEPVPPRIAAALEAMRAGRAVVLQDDHDRENEADLIVAAERITPETMALLIRECSGIVCLCLTDDTVRALELPPMVQTNESRNGTAFTVSIEAREGVHTGVSAADRVTTIRAAIAEGAKPHDIVRPGHVFPLRAQPGGVLARRGHTEGTVDLSILAGLKPAGVLCELMNPDGTMTRGDDVERFAQQHGLPMLTIAELVEFREALAAARERCCEPA

SEQ ID NO: 19914 - protein, 262 aa, Ehrlichia canis str. Jake
MYHVNRIYPKKELSQCFISSSHITDKIVNYAGNISDYSIIEIGPGLGTMTYSILNKNPKRLISIEKDSRLMPIHKKIVDEFNGKYEFILSDALNIDLRTIIEPPVKIIANLPYHIATPLLMKWINYIDFFTSFTLMFQKEVADRIVAQPNNKNYSILSVLIQLLSNVYKMEDFGPEIFSPQPKVMSSVINIIVLPKPRFNVNHNKLSQVLKVTFGERRKMIRSTLKKLINNTDEILQSLNINNNLRPENLSIEQFCKIANSI

SEQ ID NO: 19915 - protein, 255 aa, Ehrlichia canis str. Jake
MSSSLIAGTLFLVIFMSLLIVANWKMYGDFITFSSFTKELSINLTNVKADLEVVLCPPFIALPKVVDCISCIKFGAQNCFYETEGKYTGEVSAKMLYDCGCSYVIVGHSERRSIFHESDYHVQLKASAAIKSGLIPIVCVGETLLDRENGMLKDSLLNQCYNSFPKSGKFIIAYEPVWAIGSNTIPSIDMITEALEVIRSYDSTSDIIYGGAVNQDNIRDVIAINQLSGVLVGSASLKLDSFYNIIHGAVNVRQN

SEQ ID NO: 19916 - protein, 140 aa, Bradyrhizobium sp. BTAi1
MAIERTFSIIKPDATERNLTGAINALIEKAGLRIVAQKRIRMTREQAETFYAVHKARPFFGELVDFMISGPVVVQVLEGEGAILKYRDVMGATDPSKAADGTIRKLHAKSIGENSVHGSDAAETAAIEIAQFFSGNEIVG

SEQ ID NO: 19917 - protein, 395 aa, Oryza sativa
  misc_feature (240)..(240): Xaa can be any naturally occurring amino acid
  unsure (1)..(395): unsure at all Xaa locations
MTTRNGQIKNFTSNSGPQHPAAHGVSRSVLEMNGEVVERAEPHIGSLHRGTEKLIEYKTYLQALPYFDRSDYVSTMAQEHAHSSAVERLLNCEVPLRAQYIRVLFCEITRISNHSLASTTHAMDVGASTPFLWAFEEREKLLEFYERVPGARMHASFIRPGGVAQDLPLGLCRDIDSSTQQFASRIDELEEMSTGNRIWKQRLVDIGTVTAQQAKDWGFSGVMLRGPGVCWDSRRAAPYXDVYDQLDFDVPVGTRGDCYDRYCIRIEEMRQSVRIIVQCLNQMPSGMIKADDRKLCPPSRSRMKLSMESLIHHFELYTEGFSVPASSTYTAVEAPKGEFGVFLVSNGSNRPYRCKIRAPGFAHLQGLDFMSKHHMLADVVTIIGTQDIVFGEVDR

SEQ ID NO: 19918 - protein, 331 aa, Kineococcus radiotolerans SRS30216
MNLLPRSRGPSRLPEPPTMPATRTNRPRPPRRAPQKIPPTTGATHVPTHIPTTTLNNGVQMPVLGFGVFQVPAEEAERVVTDALAAGYRHLDTAAAYENEAGVGRAIAASGIPREELFVTTKLWIQDAGEQAAPAAFDRSLQRLGLDYLDLYLIHQPYGDYYGSWRAMEELNRTGRARAIGVSNFHPDRLVDLIDHTEVVPAVNQIETHPFFQRGTDHDVMRQRGVQHESWGPLGQGRDDLLTYPLLTELATAHGKTVAQVVLRWLLQRDTVVIPKSSRPQRMAENLDVFDFSLTEQEMTRIASLDTGVSAVFDHRDPASVAAFGTVRFDT

SEQ ID NO: 19919 - protein, 341 aa, Pseudoalteromonas tunicata D2
MKALSKLKAEPGIWMTEAAKPEVGHNDLLIKIRKTAICGTDVHIYKWDEWAQNTIPVPMVVGHEYVGEVVDMGQEVRGFKIGDRVSGEGHITCGHCRNCRAGRVHLCRNTIGVGVNREGSFAEYLVIPAYNAFKIPDNISDELASIFDPFGNAVHTALSFDLVGEDVLITGAGPIGIMAAAVAKHVGARYVVVTDVNEYRLDLARKMGATRAVNIANEKLEDVMKELGMTEGFDVGLEMSGVPSAFKNMLSNMNHGGKIAMLGIPPSDMAVDWNQVIFKGLVIKGIYGREMFETWYKMASLIQSGLDLSPIITHQFPIDQFQQGFDTMLSGQSGKVILDWC

SEQ ID NO: 19920 - protein, 228 aa, uncultured cyanobacterium
HEVVATAQHELGMKFAELIQAADNVMIYKYVVRNVAKKYGKTATFMPKPIFADNGSGMHVHQSLWKAGQPLFFAPGTYANLSDTARWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGAGVDVDLFELPADELAKIATVPASLNGALEALRADHHYLLEGGVFTD

SEQ ID NO: 19921 - protein, 210 aa, Neorickettsia sennetsu str. Miyayama
MFSTVEEVIHQLKERNKPFVLVDSSDRENEGDIVVPVQILTSEIMNFVVTHCRGLPCVCVTKSLCEKLGLDLIKRSDSCESSNVARFVTTIEAKEGVSTGISVRDRVRTMRLLANDNVDKDSFVSPGHVFPLMIEEGGLMVRSGHTEGAATFARLAGFKSESMLCEILDEAGDAARLPYLTDFARKYDLCLTSIDLLITYLKEKGTSILF

SEQ ID NO: 19922 - protein, 341 aa, Triticum aestivum
  misc_feature (85)..(85): Xaa can be any naturally occurring amino acid
  misc_feature (137)..(137): Xaa can be any naturally occurring amino acid
  misc_feature (173)..(173): Xaa can be any naturally occurring amino acid
  unsure (1)..(341): unsure at all Xaa locations
MGELAWAALAGLLVPLAAVALDAAVRAAHAWYWTASLGAGRRGRLPPGDMGWPLVGGMWAFLCAFKSGRPDSFIDSFARRFGRAXGLYRAFMFSSPTILVTTPDACKQVLMDDDTFVTGWPKATVALIGPKSFINMXGYDEHRRLRKLTAAPINGFDALTSYLGFIDHTVVTXLRGWSDRGSDFEFLTELRRMTFRIIVQIFMGGADERTAAELESTYTELNYGMRAMAIDLPGFAYHKAIRARRRLVAALQCVLDERRARGAKTAGVDMMDRLIAAEDEGGRRLQDDEIIDVLVMYLNAGHESSGHITMWATVFLQENPEILAKAKAEQEAIMRSIPSGQ

SEQ ID NO: 19923 - protein, 335 aa, Chondrus crispus
MTAPKVGINGFGRIGRLVLRAAIEKGTCQVVAINDPFIDLDYMAYMLKYDSTHGRYAGDVSIKDGKLQVDGNSITVFAHRDPAEIPWATAAADYIVEATGVFTLKDKAAAHFKGGAKKVVISAPSKDAPMFVCGVNEAKYTPDLDIISNASCTTNCLAPLVKVIHEKYGIEEGLMTTVHATTATQKTVDGPSNKDWRGGRGRGRNIIPSSTGAAKAVGKVMPELNGKLTGMAFRVPTPDVSVVDLTVRLTSETTYEDIKATMKAAADDSMKGIMKYTEDAVVSTDFIHDDASCIFDASAGIMLNSKFCKLVAWYDNEWGYSNRVVDLIAHISKVQ

SEQ ID NO: 19924 - protein, 228 aa, uncultured cyanobacterium
HEVVATAQHELGMKFAELIQAADNVMIYKYVVRNVAKKYGKTATFMPKPIFADNGSGMHVHQSLWKAGQPLFFAPGTYANLSDTARWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGAGVDVDLFELPADELAKIATVPASLNGALEALRADHHYLLEGGVFTK

SEQ ID NO: 19925 - protein, 168 aa, Avena sterilis subsp. ludoviciana
VMASSATSVAPFQGLKSTAGLPVSRRSNAGLGSVSNGGRIRCMQVWPIEGIKKFETLSYLPPLTEEALLKQIDFLIRSKWVPCLEFSQGGFIFREHGSTPGYYDGRYWTMWKLPMFGCTDASQVIKEVEEVKKEYPDAYVRIIGFDNIRQVQCVSFIAFKPPGCEESG

SEQ ID NO: 19926 - protein, 346 aa, Burkholderia pseudomallei K96243
MKALVYHGPGRKSLDERPMPELAAPTDVIVRVTRTTICGTDLHILKGDVPSCEPGRVLGHEGVGVVHRAGGAVSTFKEGDRVLISCISSCGQCEYCRRGMYSHCATGGWILGNRIDGTQAEYVRIPHAQTSLYRIAPGADEEALVMLSDILPTGFECGVLNGRVQPGGTVAIIGAGPIGLAALLTAQFYSPAQIVMIDPDPNRLALARRFGATACIDNGQVDAVAGVKALTGDGVDCAIEAVGIPASFELCQRIIAPGGVIANVGVHGMKADLHLETLWDRNITITTRLVDTSSTPMLLKTVGAGRLDPKQLITHRFSLADIGQAYETFGHAAHTRALKVIVEVSE

SEQ ID NO: 19927 - protein, 461 aa, Burkholderia pseudomallei K96243
MTSRDERLHRGLEERHINLMALGATIGVGLFLGSATAIRAAGPAILLTYILGGVAIFLIMRALGEMAIDNPVAGAFSRYARDYIGPLAGYLTGWTYWFMWIVTCMAEITAVGVYMHMWFPDVPNWIWTFAALIVMGAVNFIAVKLYGEFEFWFALIKIVTIVLMIAGGALMIVAGVGNGGVPTGVSNLWAHGGFLPNGWPGVVDALPIVMFAYLGVEMLGLTAGEARNPEKSLAKAVNSVFWRVVIFYVGALFVIMSVYPWNQIGTQGSPFVMTFSRLGIPAAAGIINFVVLTAALSSCNSGIFSTARMLFNLAEQGQAPERLASVNRRGVPVHGVLISVALLFVGVVLNYFAPQKVFVWLTSVSTFGAIWTWCVILIAQLRFRRRVSAERLARLPLRVPCYPLSSFVALAFLAFVVVLMAFSPDTRVALVIGPLWIAALTVYYYASQAGRRSPLGAPTDG

SEQ ID NO: 19928 - protein, 579 aa, Arabidopsis thaliana
MAQVVATRSIQGSMLSPNGGSVSTRSEKLLKPASFAVKVLGNEAKRSGRVSVRSRRVVDTTVRSARVETEVIPVSPEDVPNREEQLERLLEMQQFGDTSVGMWSKPTVRRKTKIVCTVGPSTNTREMIWKLAEAGMNVARMNMSHGDHASHKKVIDLVKEYNAQTKDNTIAIMLDTKGPEVRSGDLPQPIMLDPGQEFTFTIERGVSTPSCVSVNYDDFVNDVEAGDMLLVDGGMMSFMVKSKTKDSVKCEVVDGGELKSRRHLNVRGKSATLPSITEKDWEDIKFGVENKVDFYAVSFVKDAQVVHELKKYLQNSGADIHVIVKIESADSIPNLHSIITAPDGAMVARGDLGAELPIEEVPILQEEIINLCRSMGKAVIVATNMLESMIVHPTPTRAEVSDIAIAVREGADAVMLSGETAHGKFPLKAAGVMHTVALRTEATITSGEMPPNLGQAFKNHMSEMFAYHATMMSNTLGTSTVVFTRTGFMAILLSHYRPSGTIYAFTNEKKIQQRLALYQGVCPIYMEFTDDAEETFANALATLLKQGMVKKGEEIAIVQSGTQPIWRSQSTHNIQVRKV

SEQ ID NO: 19929 - protein, 404 aa, Vibrio fischeri ES114
MQNIGMSSKLSSVCYDIRGPVLKHAKRMEEEGHKILKLNIGNPAPFGFDAPDEILVDVIKNLPTSQGYCDSKGIYSARKAVVQHYQRRGLLDLDVEDVYIGNGASELIVMAMQALLNNGDEMLVPAPDYPLWTAAVSLSGGKPVHYMCDEGADWYPDLDDIKKKITPNTKGIVLINPNNPTGAVYSRDFLLQVVEIARQNNLIIFADEIYDKVLYDGAVHTTLATLAPDILTVTFNGLSKAYRVCGFRGGWMFLNGPKDHAQGYIAGLDMLASMRLCANVPMQHAIQTALGGYQSINELLLPGGRLLEQRDKAYDLITQIPGVSCVKPKGAMYLFPKLDPKMYKIKDDQKFVLDFLIKEKVLLVQGTGFNWPTPDHFRIVTLPRVDDLETAIGRLERFLHTYKQ

SEQ ID NO: 19930 - protein, 950 aa, Rhodococcus sp. RHA1
MIDAGSRTFADRHVGPNAAELAHILELVGADSLDDLASKAVPAVILDGVTAGIADGLDALPAPVSEHEALAELSTLAAQNTVATSMIGLGYYDTLTPPVLIRNIIENPAWYTAYTPYQPEISQGRLEALLNFQTMVADLTGMEVANSSMLDEATAAAEAMTLLRRASKSKSPRFVVDADLFPQTLAVVETRAEPLGIEIVVADLSVGLPDGDFFGVLAQMPGGSGRIVDYTDVIAAAHERGALVAVGADLLALTLLTPPGEIGADACFGTTQRFGVPMGFGGPHAGYLAVHTKHARQLPGRLVGVSVDADGDKAYRLALQTREQHIRREKATSNICTAQVLLAILAAMYASYHGAEGLKAIALRVANTAHSLAAALRKTGAVVVHEHYFDTILVRVDGRAADVVAKAKDAGINLRLVDADHVAIACDEATTADDVTQVLAAFGGEGAVTEEVGTSVPDAQLRGSDYLQHEAFTRYRTETAMLRYLRALSDKDIALDRSMIPLGSCTMKLNATAEMEAITWPAFAGLHPFAPTGDTPGILRIIKDLENWLVAVTGYDAVSLQPNAGSQGEYAGLLAIRNYHLSRGDDHRDTCLIPSSAHGTNAASAVMAGMRVEVVACRPNGDVDLDDLRAKIADHAERLAAIMITYPSTHGVYEHEIADICAAVHDAGGQVYVDGANLNALVGLARPGRFGGDVSHLNLHKTFCIPHGGGGPGVGPIGVRSHLTPFLPGHPLAPELGTAGPISAAPYGSASILPITWAYIRMMGAVGLRRASLTAIASANYIARRLDEYFPVLYTGEGGMVAHECILDLRPITKDTGVTVDDVAKRLADYGFHAPTMSFPVAGTLMVEPTESENLEEIDAFCEAMIAIRAEIDRVGAGEWPVDDNPLRGAPHTSGCLVAEWNHPYTRETAVFPRGKARPKVWPAVRRIDGAHGDRNLVCSCPPISAFEGA

SEQ ID NO: 19931 - protein, 341 aa, Kineococcus radiotolerans SRS30216
MRAVVMHAPRDVRVEDRPEPRIQKPTDAIIRLAATCICGSDLWPYRGADEVSEPLPMGHEYAGVVEEIGADVHDIEVGDFVVGSFFASDNTCEICRAGYQTSCLHREVLGTGGGAQAERMRVPLADGTLVATPAMPDADLIPSLLAASDVLGTGWFGAVAAEAGPGKTVAVVGDGAVGLSAVLAAKQLGAEKIVLFSRHADRQALGREFGATDVIEERGDEGIAKLKELTGGLGAHSVVEAVGTHESMHQAIGSTRPGGHVGFVGVLHDVAITGEDIFMTHVHLHGGPAPVRRFLPELIDLIWTRRIDPGKVFDLELPLDEAAEGYRAMDERRATKVLLRP

SEQ ID NO: 19932 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETAAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCRRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 19933 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETYAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCRRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 19934 - protein, 380 aa, Trifolium repens
MSNTAGQVIKCRAAVAWEAGKPLVIEEVEVAPPQAGEVRLKILFTSLCHTDVYFWEAKGQTPLFPRIFGHEAGGIVESVGEGVTHLKPGDHALPVFTGECGECPHCKSEESNMCNLLRINTDRGVMINDNKSRFSIKGQPVHHFVGTSTFSEYTVVHAGCVAKINPDAPLDKVCILSCGICTGLGATVNVAKPKPGSSVAIFGLGAVGLAAAEGARMSGASRIIGVDLVSSRFELAKKFGVNEFVNPKDHDKPVQQVIAEMTDGGVDRAVECTGSIQAMISAFECVHDGWGVAVLVGVPKKDDAFKTHPMNFLNERTLKGTFYGNYKPRTDLPNVVEQYMKGELELEKFITHSIPFSEINKAFDYMLKGESIRCIIRMEE

SEQ ID NO: 19935 - protein, 430 aa, Desulfitobacterium hafniense Y51
MKTFRDPVHNIVSIDKQSEKVLLDLIDTREFQRLRHTRQLGLSSFTYPGAEHTRFMHSLGVVHLTKRFIDKISTLKNIDQKYIDELHDNRMLALVTALLHDIGHGPFSHALEKTTKIKHESWTIEIITGDTEVKKILEYHRSGFSHEVAEVIRRTHKSKAIVKLLSSQLDTDRIDYLIRDSKFTGAGYGAFDLEWLINCLRIGEVNGDTEFGLDLNKGLSIAEDFVMARYYMYVNVYFHRATRSAELIMDKIFQRAIELNNLGKIDLPEDLAEIIIKSSTSKTLTNYLNLSENTIWHYIVLWSKHEDNIMSDLCTRLLNRKLFKEIQIEGNLIDFTEKVINSLKEHGLPREYYLLTDEATSSSYKDHYITQKPKSEGSENEKEASEQIFLFDKSGNGIELSNKSKIINQIRNEGIKIDRMFIPEQIRRLF

SEQ ID NO: 19936 - protein, 136 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFDTDLCTVSTVTHPDTMMDGTGQCGSFPCSVAPTPLKC

SEQ ID NO: 19937 - protein, 496 aa, Nitrosomonas europaea ATCC 19718
MMRRTKIVATLGPASSNAEVLGRMLEAGVDVIRINFSHGTKDEHIASVELVRSLARSLGRTVGVLADLQGPKIRIGKFEQGKIRLKTGDEFILDAECQLGNQERVGLDYRELPNDVEAGATLLLDDGRIVLTVAKVRESEIFCEVLQGGILSNNKGINRKGGGLSAPALTAKDLLDIKTSAVIRADYLAVSFPRSGDDIRRARALMQEAQGHSLLMAKIERSEAILALDDILEASDAIMVARGDLAVEVGDAAVPALQKRMIRSAREANKLVITATQMMESMISNPIPTRAEVSDVANAVLDGTDAVMLSAESAAGQYPVEAVEAMARVCLEAEKEYTPSLRARRSPDTQSISIEDAIARATMYAAGSLNIQAIAALTQSGVTALFMSRRSSKAPIFALSPQEDTLGKVTLFRGVYPIEFGQGLCDPEIILGMAEDELLKRGAVRDEDLIIMTIGEPVGKAGGTNTMKIIKVGSSKKAAQAVREVAQQPFSDPQNL

SEQ ID NO: 19938 - protein, 272 aa, delta proteobacterium MLMS-1
MNWKRLFSRTESLGPAEARKFMDQRSAADYQLLDVRQPKEYEAAHLPGARLIPIKELAQRRAELDPARPVLVYCAVGGRSRAAAQYLNGQGFKEVYNMAGGIKAWEGGKAAGPVEAGLELLSAEAEYDEAAALAHAMEDGLQRFYLKLAADSGDAALKKTYQHLAGLEEGHKARLAREYRDKTGKNLKPTGQDELLEGGRTPAAFTAATPVQALDQAMGLEFQAQDLYLRLAAQSEMAASRDFFLAMAAEEKEHLAFLAKELEKIGEVNHAA

SEQ ID NO: 19939 - protein, 1821 aa, Artificial sequence
  consensus amino acid sequence
  misc_feature (1)..(1): location 1 can be a Gap or Met
  misc_feature (2)..(2): location 2 can be a Gap or Pro
  misc_feature (3)..(3): location 3 can be a Gap or Pro
  misc_feature (4)..(4): location 4 can be a Gap or Ala
  misc_feature (5)..(5): location 5 can be a Gap or Pro
  misc_feature (6)..(6): location 6 can be a Gap or Trp
  misc_feature (7)..(7): location 7 can be a Gap or Pro
  misc_feature (8)..(8): location 8 can be a Gap or Thr
  misc_feature (9)..(9): location 9 can be a Gap or Pro
  misc_feature (10)..(10): location 10 can be a Gap or Arg
  misc_feature (11)..(11): location 11 can be a Gap or Thr
  misc_feature (12)..(12): location 12 can be a Gap or Val
  misc_feature (13)..(13): location 13 can be a Gap or Arg
  misc_feature (14)..(14): location 14 can be a Gap or Gln
  misc_feature (15)..(15): location 15 can be a Gap or Ala
  misc_feature (16)..(16): location 16 can be a Gap or Ala
  misc_feature (17)..(17): location 17 can be a Gap or Glu
  misc_feature (18)..(18): location 18 can be a Gap or Leu
  misc_feature (19)..(19): location 19 can be a Gap or His
  misc_feature (20)..(20): location 20 can be a Gap or Ala
  misc_feature (21)..(21): location 21 can be a Gap or His
  misc_feature (22)..(22): location 22 can be a Gap or Leu
  misc_feature (23)..(23): location 23 can be a Gap or Thr
  misc_feature (24)..(24): location 24 can be a Gap or Thr
  misc_feature (25)..(25): location 25 can be a Gap or Ser
  misc_feature (26)..(26): location 26 can be a Gap or Gly
  misc_feature (27)..(27): location 27 can be a Gap or Arg
  misc_feature (28)..(28): location 28 can be a Gap or Leu
  misc_feature (29)..(29): location 29 can be a Gap or Leu
  misc_feature (30)..(30): location 30 can be a Gap or His
  misc_feature (31)..(31): location 31 can be a Gap or Pro
  misc_feature (32)..(32): location 32 can be a Gap or Pro
  misc_feature (33)..(33): location 33 can be a Gap or Ser
  misc_feature (34)..(34): location 34 can be a Gap or Ala
  misc_feature (35)..(35): location 35 can be a Gap or His
  misc_feature (36)..(36): location 36 can be a Gap or His
  misc_feature (37)..(37): location 37 can be a Gap or Leu
  misc_feature (38)..(38): location 38 can be a Gap or Leu
  misc_feature (39)..(39): location 39 can be Asn or a Gap
  misc_feature (40)..(40): location 40 can be a Gap or Ser
  misc_feature (41)..(41): location 41 can be a Gap or Leu
  misc_feature (42)..(42): location 42 can be a Gap or Val
  misc_feature (43)..(43): location 43 can be Asn or a Gap
  misc_feature (44)..(44): location 44 can be a Gap or Cys
  misc_feature (45)..(45): location 45 can be a Gap or Leu
  misc_feature (46)..(46): location 46 can be a Gap or Pro
  misc_feature (47)..(47): location 47 can be a Gap or Pro
  misc_feature (48)..(48): location 48 can be a Gap or Ser
  misc_feature (49)..(49): location 49 can be a Gap or Asp
  misc_feature (50)..(50): location 50 can be a Gap or Pro
  misc_feature (51)..(51): location 51 can be a Gap or Leu
  misc_feature (52)..(52): location 52 can be a Gap or His
  misc_feature (53)..(53): location 53 can be a Gap or Leu
  misc_feature (54)..(54): location 54 can be a Gap or Arg
  misc_feature (55)..(55): location 55 can be a Gap or Tyr
  misc_feature (56)..(56): location 56 can be a Gap or Ala
  misc_feature (57)..(57): location 57 can be a Gap or Leu
  misc_feature (58)..(58): location 58 can be a Gap or His
  misc_feature (59)..(59): location 59 can be a Gap or Leu
  misc_feature (60)..(60): location 60 can be a Gap or Phe
  misc_feature (61)..(61): location 61 can be a Gap or Asp
  misc_feature (62)..(62): location 62 can be a Gap or Arg
  misc_feature (63)..(63): location 63 can be a Gap or Met
  misc_feature (64)..(64): location 64 can be a Gap or Pro
  misc_feature (65)..(65): location 65 can be a Gap or Ala
  misc_feature (66)..(66): location 66 can be a Gap or Ser
  misc_feature (67)..(67): location 67 can be a Gap or Thr
  misc_feature (68)..(68): location 68 can be a Gap or Phe
  misc_feature (69)..(69): location 69 can be a Gap or Leu
  misc_feature (70)..(70): location 70 can be a Gap or Phe
  misc_feature (71)..(71): location 71 can be a Gap or Asp
  misc_feature (72)..(72): location 72 can be a Gap or Thr
  misc_feature (73)..(73): location 73 can be a Gap or Ala
  misc_feature (74)..(74): location 74 can be a Gap or Leu
  misc_feature (75)..(75): location 75 can be a Gap or Arg
  misc_feature (76)..(76): location 76 can be a Gap or Ala
  misc_feature (77)..(77): location 77 can be a Gap or Cys
  misc_feature (78)..(78): location 78 can be a Gap or Phe
  misc_feature (79)..(79): location 79 can be a Gap or Arg
  misc_feature (80)..(80): location 80 can be a Gap or Ala
  misc_feature (81)..(81): location 81 can be a Gap or Gly
  misc_feature (82)..(82): location 82 can be a Gap or Thr
  misc_feature (83)..(83): location 83 can be a Gap or Ser
  misc_feature (84)..(84): location 84 can be a Gap or Ser
  misc_feature (85)..(85): location 85 can be a Gap or Gly
  misc_feature (86)..(86): location 86 can be a Gap or Asp
  misc_feature (87)..(87): location 87 can be a Gap or Pro
  misc_feature (88)..(88): location 88 can be a Gap or Asp
  misc_feature (89)..(89): location 89 can be Ile or a Gap
  misc_feature (90)..(90): location 90 can be a Gap or Pro
  misc_feature (91)..(91): location 91 can be a Gap or Phe
  misc_feature (92)..(92): location 92 can be a Gap or Val
  misc_feature (93)..(93): location 93 can be a Gap or Leu
  misc_feature (94)..(94): location 94 can be a Gap or Phe
  misc_feature (95)..(95): location 95 can be a Gap or Arg
  misc_feature (96)..(96): location 96 can be a Gap or Arg
  misc_feature (97)..(97): location 97 can be a Gap or Met
  misc_feature (98)..(98): location 98 can be a Gap or Arg
  misc_feature (99)..(99): location 99 can be a Gap or Arg
  misc_feature (100)..(100): location 100 can be a Gap or Ala
  misc_feature (101)..(101): location 101 can be a Gap or Ala
  misc_feature (102)..(102): location 102 can be a Gap or Val
  misc_feature (103)..(103): location 103 can be a Gap or Arg
  misc_feature (104)..(104): location 104 can be a Gap or Pro
  misc_feature (105)..(105): location 105 can be a Gap or Asp
  misc_feature (106)..(106): location 106 can be a Gap or Gly
  misc_feature (107)..(107): location 107 can be a Gap or Phe
  misc_feature (108)..(108): location 108 can be a Gap or Thr
  misc_feature (109)..(109): location 109 can be a Gap or Phe
  misc_feature (110)..(110): location 110 can be a Gap or His
  misc_feature (111)..(111): location 111 can be a Gap or Phe
  misc_feature (112)..(112): location 112 can be a Gap or Leu
  misc_feature (113)..(113): location 113 can be a Gap or Phe
  misc_feature (114)..(114): location 114 can be a Gap or Lys
  misc_feature (115)..(115): location 115 can be a Gap or Cys
  misc_feature (116)..(116): location 116 can be a Gap or Ser
  misc_feature (117)..(117): location 117 can be a Gap or Ser
  misc_feature (118)..(118): location 118 can be a Gap or Ser
  misc_feature (119)..(119): location 119 can be a Gap or Ser
  misc_feature (120)..(120): location 120 can be a Gap or Arg
  misc_feature (121)..(121): location 121 can be a Gap or Pro
  misc_feature (122)..(122): location 122 can be a Gap or Arg
  misc_feature (123)..(123): location 123 can be a Gap or Ala
  misc_feature (124)..(124): location 124 can be a Gap or Leu
  misc_feature (125)..(125): location 125 can be a Gap or Leu
  misc_feature (126)..(126): location 126 can be a Gap or Cys
  misc_feature (127)..(127): location 127 can be a Gap or Thr
  misc_feature (128)..(128): location 128 can be a Gap or Met
  misc_feature (129)..(129): location 129 can be a Gap or Leu
  misc_feature (130)..(130): location 130 can be a Gap or His
  misc_feature (131)..(131): location 131 can be a Gap or Ala
  misc_feature (132)..(132): location 132 can be a Gap or Ala
  misc_feature (133)..(133): location 133 can be a Gap or Cys
  misc_feature (134)..(134): location 134 can be a Gap or Leu
  misc_feature (135)..(135): location 135 can be a Gap or Arg
  misc_feature (136)..(136): location 136 can be a Gap or Thr
  misc_feature (137)..(137): location 137 can be a Gap or Met
  misc_feature (138)..(138): location 138 can be a Gap or Leu
  misc_feature (139)..(139): location 139 can be a Gap or Pro
  misc_feature (140)..(140): location 140 can be a Gap or Ser
  misc_feature (141)..(141): location 141 can be a Gap or Ala
  misc_feature (142)..(142): location 142 can be a Gap or Ala
  misc_feature (143)..(143): location 143 can be a Gap or Pro
  misc_feature (144)..(144): location 144 can be a Gap or Phe
  misc_feature (145)..(145): location 145 can be a Gap or Val
  misc_feature (146)..(146): location 146 can be a Gap or Ala
  misc_feature (147)..(147): location 147 can be Asn or a Gap
  misc_feature (148)..(148): location 148 can be a Gap or Ser
  misc_feature (149)..(149): location 149 can be a Gap or Leu
  misc_feature (150)..(150): location 150 can be Ile or a Gap
  misc_feature (151)..(151): location 151 can be a Gap or His
  misc_feature (152)..(152): location 152 can be a Gap or Met
  misc_feature (153)..(153): location 153 can be a Gap or Tyr
  misc_feature (154)..(154): location 154 can be a Gap or Thr
  misc_feature (155)..(155): location 155 can be a Gap or Glu
  misc_feature (156)..(156): location 156 can be a Gap or Leu
  misc_feature (157)..(157): location 157 can be a Gap or Gly
  misc_feature (158)..(158): location 158 can be a Gap or Leu
  misc_feature (159)..(159): location 159 can be a Gap or Ala
  misc_feature (160)..(160): location 160 can be a Gap or Gly
  misc_feature (161)..(161): location 161 can be a Gap or Asp
  misc_feature (162)..(162): location 162 can be a Gap or Val
  misc_feature (163)..(163): location 163 can be a Gap or Arg
  misc_feature (164)..(164): location 164 can be a Gap or Arg
  misc_feature (165)..(165): location 165 can be a Gap or Ala
  misc_feature (166)..(166): location 166 can be a Gap or Phe
  misc_feature (167)..(167): location 167 can be a Gap or Asp
  misc_feature (168)..(168): location 168 can be a Gap or Glu
  misc_feature (169)..(169): location 169 can be Ile or a Gap
  misc_feature (170)..(170): location 170 can be a Gap or Pro
  misc_feature (171)..(171): location 171 can be a Gap or Val
  misc_feature (172)..(172): location 172 can be a Gap or Lys
  misc_feature (173)..(173): location 173 can be a Gap or Asp
  misc_feature (174)..(174): location 174 can be a Gap or Ala
  misc_feature (175)..(175): location 175 can be a Gap or Val
  misc_feature (176)..(176): location 176 can be a Gap or Ser
  misc_feature (177)..(177): location 177 can be a Gap or Trp
  misc_feature (178)..(178): location 178 can be a Gap or Thr
  misc_feature (179)..(179): location 179 can be a Gap or Met
  misc_feature (180)..(180): location 180 can be a Gap or Val
  misc_feature (181)..(181): location 181 can be Ile or a Gap
  misc_feature (182)..(182): location 182 can be a Gap or Ser
  misc_feature (183)..(183): location 183 can be a Gap or Gly
  misc_feature (184)..(184): location 184 can be a Gap or Leu
  misc_feature (185)..(185): location 185 can be a Gap or Ala
  misc_feature (186)..(186): location 186 can be a Gap or Lys
  misc_feature (187)..(187): location 187 can be a Gap or Met
  misc_feature (188)..(188): location 188 can be a Gap or Gly
  misc_feature (189)..(189): location 189 can be a Gap or Met
  misc_feature (190)..(190): location 190 can be a Gap or Leu
  misc_feature (191)..(191): location 191 can be a Gap or Ser
  misc_feature (192)..(192): location 192 can be a Gap or Asp
  misc_feature (193)..(193): location 193 can be a Gap or Ala
  misc_feature (194)..(194): location 194 can be a Gap or Arg
  misc_feature (195)..(195): location 195 can be a Gap or Leu
  misc_feature (196)..(196): location 196 can be a Gap or Leu
  misc_feature (197)..(197): location 197 can be a Gap or Leu
  misc_feature (198)..(198): location 198 can be a Gap or Ala
  misc_feature (199)..(199): location 199 can be a Gap or Gln
  misc_feature (200)..(200): location 200 can be a Gap or Ala
  misc_feature (201)..(201): location 201 can be a Gap or Pro
  misc_feature (202)..(202): location 202 can be a Gap or Val
  misc_feature (203)..(203): location 203 can be a Gap or Arg
  misc_feature (204)..(204): location 204 can be a Gap or Asp
  misc_feature (205)..(205): location 205 can be a Gap or Val
  misc_feature (206)..(206): location 206 can be Ile or a Gap
  misc_feature (207)..(207): location 207 can be a Gap or Ser
  misc_feature (208)..(208): location 208 can be a Gap or Trp
  misc_feature (209)..(209): location 209 can be a Gap or Thr
  misc_feature (210)..(210): location 210 can be a Gap or Ser
  misc_feature (211)..(211): location 211 can be a Gap or Leu
  misc_feature (212)..(212): location 212 can be Ile or a Gap
  misc_feature (213)..(213): location 213 can be a Gap or Ala
  misc_feature (214)..(214): location 214 can be a Gap or Ala
  misc_feature (215)..(215): location 215 can be a Gap or Tyr
  misc_feature (216)..(216): location 216 can be a Gap or Ser
  misc_feature (217)..(217): location 217 can be a Gap or Arg
  misc_feature (218)..(218): location 218 can be a Gap or Ala
  misc_feature (219)..(219): location 219 can be a Gap or Asp
  misc_feature (220)..(220): location 220 can be a Gap or Arg
  misc_feature (221)..(221): location 221 can be a Gap or Ala
  misc_feature (222)..(222): location 222 can be a Gap or Lys
  misc_feature (223)..(223): location 223 can be a Gap or Glu
  misc_feature (224)..(224): location 224 can be a Gap or Ala
  misc_feature (225)..(225): location 225 can be a Gap or Val
  misc_feature (226)..(226): location 226 can be a Gap or Asp
  misc_feature (227)..(227): location 227 can be a Gap or Cys
  misc_feature (228)..(228): location 228 can be a Gap or Phe
  misc_feature (229)..(229): location 229 can be a Gap or Lys
  misc_feature (230)..(230): location 230 can be Asn or a Gap
  misc_feature (231)..(231): location 231 can be a Gap or Met
  misc_feature (232)..(232): location 232 can be a Gap or Leu
  misc_feature (233)..(233): location 233 can be a Gap or Ser
  misc_feature (234)..(234): location 234 can be a Gap or Glu
  misc_feature (235)..(235): location 235 can be a Gap or Gly
  misc_feature (236)..(236): location 236 can be Ile or a Gap
  misc_feature (237)..(237): location 237 can be a Gap or Ala
  misc_feature (238)..(238): location 238 can be a Gap or Pro
  misc_feature (239)..(239): location 239 can be a Gap or Asp
  misc_feature (240)..(240): location 240 can be a Gap or Asp
  misc_feature (241)..(241): location 241 can be a Gap or Val
  misc_feature (242)..(242): location 242 can be a Gap or Thr
  misc_feature (243)..(243): location 243 can be a Gap or Val
  misc_feature (244)..(244): location 244 can be Ile or a Gap
  misc_feature (245)..(245): location 245 can be a Gap or Gly
  misc_feature (246)..(246): location 246 can be a Gap or Val
  misc_feature (247)..(247): location 247 can be a Gap or Leu
  misc_feature (248)..(248): location 248 can be a Gap or Ser
  misc_feature (249)..(249): location 249 can be a Gap or Ala
  misc_feature (250)..(250): location 250 can be a Gap or Cys
  misc_feature (251)..(251): location 251 can be a Gap or Ser
  misc_feature (252)..(252): location 252 can be a Gap or Gln
  misc_feature (253)..(253): location 253 can be a Gap or Leu
  misc_feature (254)..(254): location 254 can be a Gap or Lys
  misc_feature (255)..(255): location 255 can be a Gap or Asp
  misc_feature (256)..(256): location 256 can be a Gap or Leu
  misc_feature (257)..(257): location 257 can be a Gap or Glu
  misc_feature (258)..(258): location 258 can be a Gap or Leu
  misc_feature (259)..(259): location 259 can be a Gap or Gly
  misc_feature (260)..(260): location 260 can be a Gap or Cys
  misc_feature (261)..(261): location 261 can be a Gap or Ser
  misc_feature (262)..(262): location 262 can be a Gap or Leu
  misc_feature (263)..(263): location 263 can be a Gap or His
  misc_feature (264)..(264): location 264 can be a Gap or Leu
  misc_feature (265)..(265): location 265 can be a Gap or Leu
  misc_feature (266)..(266): location 266 can be a Gap or Val
  misc_feature (267)..(267): location 267 can be a Gap or Lys
  misc_feature (268)..(268): location 268 can be a Gap or Glu
  misc_feature (269)..(269): location 269 can be a Gap or Lys
  misc_feature (270)..(270): location 270 can be a Gap or Gly
  misc_feature (271)..(271): location 271 can be a Gap or Met
  misc_feature (272)..(272): location 272 can be a Gap or Ser
  misc_feature (273)..(273): location 273 can be a Gap or Met
  misc_feature (274)..(274): location 274 can be a Gap or Ser
  misc_feature (275)..(275): location 275 can be a Gap or Glu
  misc_feature (276)..(276): location 276 can be Asn or a Gap
  misc_feature (277)..(277): location 277 can be a Gap or Leu
  misc_feature (278)..(278): location 278 can be a Gap or Val
  misc_feature (279)..(279): location 279 can be a Gap or Val
  misc_feature (280)..(280): location 280 can be a Gap or Ala
  misc_feature (281)..(281): location 281 can be a Gap or Leu
  misc_feature (282)..(282): location 282 can be Ile or a Gap
  misc_feature (283)..(283): location 283 can be a Gap or Asp
  misc_feature (284)..(284): location 284 can be a Gap or Met
  misc_feature (285)..(285): location 285 can be a Gap or Tyr
  misc_feature (286)..(286): location 286 can be a Gap or Ala
  misc_feature (287)..(287): location 287 can be a Gap or Lys
  misc_feature (288)..(288): location 288 can be a Gap or Cys
  misc_feature (289)..(289): location 289 can be a Gap or Gly
  misc_feature (290)..(290): location 290 can be a Gap or Asp
  misc_feature (291)..(291): location 291 can be a Gap or Phe
  misc_feature (292)..(292): location 292 can be a Gap or Gly
  misc_feature (293)..(293): location 293 can be a Gap or His
  misc_feature (294)..(294): location 294 can be a Gap or Ala
  misc_feature (295)..(295): location 295 can be a Gap or Arg
  misc_feature (296)..(296): location 296 can be a Gap or Glu
  misc_feature (297)..(297): location 297 can be a Gap or Val
  misc_feature (298)..(298): location 298 can be a Gap or Phe
  misc_feature (299)..(299): location 299 can be a Gap or Asp
  misc_feature (300)..(300): location 300 can be a Gap or Ala
  misc_feature (301)..(301): location 301 can be a Gap or Val
  misc_feature (302)..(302): location 302 can be a Gap or Gly
  misc_feature (303)..(303): location 303 can be a Gap or Arg
  misc_feature (304)..(304): location 304 can be a Gap or Gly
  misc_feature (305)..(305): location 305 can be a Gap or Arg
  misc_feature (306)..(306): location 306 can be a Gap or Arg
  misc_feature (307)..(307): location 307 can be a Gap or Pro
  misc_feature (308)..(308): location 308 can be a Gap or Gln
  misc_feature (309)..(309): location 309 can be a Gap or Ser
  misc_feature (310)..(310): location 310 can be a Gap or Trp
  misc_feature (311)..(311): location 311 can be Asn or a Gap
  misc_feature (312)..(312): location 312 can be a Gap or Ala
  misc_feature (313)..(313): location 313 can be Ile or a Gap
  misc_feature (314)..(314): location 314 can be Ile or a Gap
  misc_feature (315)..(315): location 315 can be a Gap or Asp
  misc_feature (316)..(316): location 316 can be a Gap or Gly
  misc_feature (317)..(317): location 317 can be a Gap or Tyr
  misc_feature (318)..(318): location 318 can be a Gap or Cys
  misc_feature (319)..(319): location 319 can be a Gap or Lys
  misc_feature (320)..(320): location 320 can be a Gap or His
  misc_feature (321)..(321): location 321 can be a Gap or Gly
  misc_feature (322)..(322): location 322 can be a Gap or His
  misc_feature (323)..(323): location 323 can be a Gap or Val
  misc_feature (324)..(324): location 324 can be a Gap or Asp
  misc_feature (325)..(325): location 325 can be a Gap or Val
  misc_feature (326)..(326): location 326 can be a Gap or Ala
  misc_feature (327)..(327): location 327 can be a Gap or Arg
  misc_feature (328)..(328): location 328 can be a Gap or Ser
  misc_feature (329)..(329): location 329 can be a Gap or Leu
  misc_feature (330)..(330): location 330 can be a Gap or Phe
  misc_feature (331)..(331): location 331 can be a Gap or Asp
  misc_feature (332)..(332): location 332 can be a Gap or Gln
  misc_feature (333)..(333): location 333 can be a Gap or Met
  misc_feature (334)..(334): location 334 can be a Gap or Glu
  misc_feature (335)..(335): location 335 can be a Gap or Val
  misc_feature (336)..(336): location 336 can be a Gap or Arg
  misc_feature (337)..(337): location 337 can be a Gap or Asp
  misc_feature (338)..(338): location 338 can be Ile or a Gap
  misc_feature (339)..(339): location 339 can be Ile or a Gap
  misc_feature (340)..(340): location 340 can be a Gap or Thr
  misc_feature (341)..(341): location 341 can be a Gap or Phe
  misc_feature (342)..(342): location 342 can be Asn or a Gap
  misc_feature (343)..(343): location 343 can be a Gap or Ser
  misc_feature (344)..(344): location 344 can be a Gap or Met
  misc_feature (345)..(345): location 345 can be Ile or a Gap
  misc_feature (346)..(346): location 346 can be a Gap or Thr
  misc_feature (347)..(347): location 347 can be a Gap or Gly
  misc_feature (348)..(348): location 348 can be a Gap or Tyr
  misc_feature (349)..(349): location 349 can be Ile or a Gap
  misc_feature (350)..(350): location 350 can be a Gap or His
  misc_feature (351)..(351): location 351 can be a Gap or Ser
  misc_feature (352)..(352): location 352 can be a Gap or Gly
  misc_feature (353)..(353): location 353 can be a Gap or Gln
  misc_feature (354)..(354): location 354 can be a Gap or Leu
  misc_feature (355)..(355): location 355 can be a Gap or Arg
  misc_feature (356)..(356): location 356 can be a Gap or Glu
  misc_feature (357)..(357): location 357 can be a Gap or Ala
  misc_feature (358)..(358): location 358 can be a Gap or Leu
  misc_feature (359)..(359): location 359 can be a Gap or Leu
  misc_feature (360)..(360): location 360 can be a Gap or Leu
  misc_feature (361)..(361): location 361 can be a Gap or Phe
  misc_feature (362)..(362): location 362 can be a Gap or Met
  misc_feature (363)..(363): location 363 can be Asn or a Gap
  misc_feature (364)..(364): location 364 can be a Gap or Met
  misc_feature (365)..(365): location 365 can be a Gap or Arg
  misc_feature (366)..(366): location 366 can be a Gap or Arg
  misc_feature (367)..(367): location 367 can be a Gap or His
  misc_feature (368)..(368): location 368 can be a Gap or Asp
  misc_feature (369)..(369): location 369 can be a Gap or Leu
  misc_feature (370)..(370): location 370 can be a Gap or Arg
  misc_feature (371)..(371): location 371 can be a Gap or Val
  misc_feature (372)..(372): location 372 can be a Gap or Asp
  misc_feature (373)..(373): location 373 can be Asn or a Gap
  misc_feature (374)..(374): location 374 can be a Gap or Phe
  misc_feature (375)..(375): location 375 can be a Gap or Thr
  misc_feature (376)..(376): location 376 can be a Gap or Val
  misc_feature (377)..(377): location 377 can be a Gap or Val
  misc_feature (378)..(378): location 378 can be a Gap or Ser
  misc_feature (379)..(379): location 379 can be a Gap or Leu
  misc_feature (380)..(380): location 380 can be a Gap or Leu
  misc_feature (381)..(381): location 381 can be a Gap or Ser
  misc_feature (382)..(382): location 382 can be a Gap or Ala
  misc_feature (383)..(383): location 383 can be a Gap or Cys
  misc_feature (384)..(384): location 384 can be a Gap or Ala
  misc_feature (385)..(385): location 385 can be a Gap or Ser
  misc_feature (386)..(386): location 386 can be a Gap or Leu
  misc_feature (387)..(387): location 387 can be a Gap or Gly
  misc_feature (388)..(388): location 388 can be a Gap or Ala
  misc_feature (389)..(389): location 389 can be a Gap or Leu
  misc_feature (390)..(390): location 390 can be a Gap or Pro
  misc_feature (391)..(391): location 391 can be a Gap or Gln
  misc_feature (392)..(392): location 392 can be a Gap or Gly
  misc_feature (393)..(393): location 393 can be a Gap or Arg
  misc_feature (394)..(394): location 394 can be a Gap or Ala
  misc_feature (395)..(395): location 395 can be a Gap or Leu
  misc_feature (396)..(396): location 396 can be a Gap or His
  misc_feature (397)..(397): location 397 can be a Gap or Ala
  misc_feature (398)..(398): location 398 can be a Gap or Cys
  misc_feature (399)..(399): location 399 can be Ile or a Gap
  misc_feature (400)..(400): location 400 can be a Gap or Glu
  misc_feature (401)..(401): location 401 can be a Gap or Leu
  misc_feature (402)..(402): location 402 can be a Gap or Arg
  misc_feature (403)..(403): location 403 can be a Gap or Leu
  misc_feature (404)..(404): location 404 can be a Gap or Val
  misc_feature (405)..(405): location 405 can be a Gap or Glu
  misc_feature (406)..(406): location 406 can be a Gap or Thr
  misc_feature (407)..(407): location 407 can be a Gap or Asp
  misc_feature (408)..(408): location 408 can be Ile or a Gap
  misc_feature (409)..(409): location 409 can be a Gap or Tyr
  misc_feature (410)..(410): location 410 can be Ile or a Gap
  misc_feature (411)..(411): location 411 can be a Gap or Gly
  misc_feature (412)..(412): location 412 can be a Gap or Thr
  misc_feature (413)..(413): location 413 can be a Gap or Ala
  misc_feature (414)..(414): location 414 can be a Gap or Leu
  misc_feature (415)..(415): location 415 can be a Gap or Leu
  misc_feature (416)..(416): location 416 can be a Gap or Asp
  misc_feature (417)..(417): location 417 can be a Gap or Met
  misc_feature (418)..(418): location 418 can be a Gap or Tyr
  misc_feature (419)..(419): location 419 can be a Gap or Met
  misc_feature (420)..(420): location 420 can be a Gap or Lys
  misc_feature (421)..(421): location 421 can be a Gap or Cys
  misc_feature (422)..(422): location 422 can be a Gap or Gly
  misc_feature (423)..(423): location 423 can be a Gap or Arg
  misc_feature (424)..(424): location 424 can be a Gap or Val
  misc_feature (425)..(425): location 425 can be Asn or a Gap
  misc_feature (426)..(426): location 426 can be a Gap or Glu
  misc_feature (427)..(427): location 427 can be a Gap or Ala
  misc_feature (428)..(428): location 428 can be a Gap or Thr
  misc_feature (429)..(429): location 429 can be Ile or a Gap
  misc_feature (430)..(430): location 430 can be a Gap or Val
  misc_feature (431)..(431): location 431 can be a Gap or Phe
  misc_feature (432)..(432): location 432 can be a Gap or Gln
  misc_feature (433)..(433): location 433 can be a Gap or Arg
  misc_feature (434)..(434): location 434 can be a Gap or Met
  misc_feature (435)..(435): location 435 can be a Gap or Gly
  misc_feature (436)..(436): location 436 can be a Gap or Lys
  misc_feature (437)..(437): location 437 can be a Gap or Arg
  misc_feature (438)..(438): location 438 can be a Gap or Asp
  misc_feature (439)..(439): location 439 can be a Gap or Val
  misc_feature (440)..(440): location 440 can be a Gap or His
  misc_feature (441)..(441): location 441 can be a Gap or Ala
  misc_feature (442)..(442): location 442 can be a Gap or Trp
  misc_feature (443)..(443): location 443 can be a Gap or Thr
  misc_feature (444)..(444): location 444 can be a Gap or Ala
  misc_feature (445)..(445): location 445 can be a Gap or Met
  misc_feature (446)..(446): location 446 can be Ile or a Gap
  misc_feature (447)..(447): location 447 can be a Gap or Ala
  misc_feature (448)..(448): location 448 can be a Gap or Gly
  misc_feature (449)..(449): location 449 can be a Gap or Leu
  misc_feature (450)..(450): location 450 can be a Gap or Ala
  misc_feature (451)..(451): location 451 can be a Gap or Phe
  misc_feature (452)..(452): location 452 can be Asn or a Gap
  misc_feature (453)..(453): location 453 can be a Gap or Gly
  misc_feature (454)..(454): location 454 can be a Gap or Met
  misc_feature (455)..(455): location 455 can be a Gap or Gly
  misc_feature (456)..(456): location 456 can be a Gap or Lys
  misc_feature (457)..(457): location 457 can be a Gap or Ala
  misc_feature (458)..(458): location 458 can be a Gap or Gly
  misc_feature (459)..(459): location 459 can be a Gap or Leu
  misc_feature (460)..(460): location 460 can be a Gap or Glu
  misc_feature (461)..(461): location 461 can be a Gap or Tyr
  misc_feature (462)..(462): location 462 can be a Gap or Phe
  misc_feature (463)..(463): location 463 can be a Gap or Tyr
  misc_feature (464)..(464): location 464 can be a Gap or Gln
  misc_feature (465)..(465): location 465 can be a Gap or Met
  misc_feature (466)..(466): location 466 can be a Gap or Arg
  misc_feature (467)..(467): location 467 can be a Gap or Cys
  misc_feature (468)..(468): location 468 can be a Gap or Asp
  misc_feature (469)..(469): location 469 can be a Gap or Gly
  misc_feature (470)..(470): location 470 can be a Gap or Phe
  misc_feature (471)..(471): location 471 can be a Gap or Gln
  misc_feature (472)..(472): location 472 can be a Gap or Pro
  misc_feature (473)..(473): location 473 can be Asn or a Gap
  misc_feature (474)..(474): location 474 can be a Gap or Pro
  misc_feature (475)..(475): location 475 can be a Gap or Val
  misc_feature (476)..(476): location 476 can be a Gap or Ser
  misc_feature (477)..(477): location 477 can be a Gap or Tyr
  misc_feature (478)..(478): location 478 can be Ile or a Gap
  misc_feature (479)..(479): location 479 can be a Gap or Ala
  misc_feature (480)..(480): location 480 can be a Gap or Val
  misc_feature (481)..(481): location 481 can be a Gap or Leu
  misc_feature (482)..(482): location 482 can be a Gap or Thr
  misc_feature (483)..(483): location 483 can be a Gap or Ala
  misc_feature (484)..(484): location 484 can be a Gap or Cys
  misc_feature (485)..(485): location 485 can be a Gap or Ser
  misc_feature (486)..(486): location 486 can be a Gap or His
  misc_feature (487)..(487): location 487 can be a Gap or Ser
  misc_feature (488)..(488): location 488 can be a Gap or Cys
  misc_feature (489)..(489): location 489 can be a Gap or Leu
  misc_feature (490)..(490): location 490 can be a Gap or Leu
  misc_feature (491)..(491): location 491 can be Asn or a Gap
  misc_feature (492)..(492): location 492 can be a Gap or Glu
  misc_feature (493)..(493): location 493 can be a Gap or Gly
  misc_feature (494)..(494): location 494 can be a Gap or Arg
  misc_feature (495)..(495): location 495 can be a Gap or Leu
  misc_feature (496)..(496): location 496 can be a Gap or Tyr
  misc_feature (497)..(497): location 497 can be a Gap or Phe
  misc_feature (498)..(498): location 498 can be a Gap or Asp
  misc_feature (499)..(499): location 499 can be a Gap or Glu
  misc_feature (500)..(500): location 500 can be a Gap or Met
  misc_feature (501)..(501): location 501 can be a Gap or Arg
  misc_feature (502)..(502): location 502 can be Ile or a Gap
  misc_feature (503)..(503): location 503 can be a Gap or Leu
  misc_feature (504)..(504): location 504 can be a Gap or Tyr
  misc_feature (505)..(505): location 505 can be Asn or a Gap
  misc_feature (506)..(506): location 506 can be Ile or a Gap
  misc_feature (507)..(507): location 507 can be a Gap or His
  misc_feature (508)..(508): location 508 can be a Gap or Pro
  misc_feature (509)..(509): location 509 can be a Gap or Gln
  misc_feature (510)..(510): location 510 can be Ile or a Gap
  misc_feature (511)..(511): location 511 can be a Gap or Glu
  misc_feature (512)..(512): location 512 can be a Gap or His
  misc_feature (513)..(513): location 513 can be a Gap or Tyr
  misc_feature (514)..(514): location 514 can be a Gap or Gly
  misc_feature (515)..(515): location 515 can be a Gap or Cys
  misc_feature (516)..(516): location 516 can be a Gap or Met
  misc_feature (517)..(517): location 517 can be Ile or a Gap
  misc_feature (518)..(518): location 518 can be a Gap or Asp
  misc_feature (519)..(519): location 519 can be a Gap or Leu
  misc_feature (520)..(520): location 520 can be a Gap or Leu
  misc_feature (521)..(521): location 521 can be a Gap or Gly
  misc_feature (522)..(522): location 522 can be a Gap or Arg
  misc_feature (523)..(523): location 523 can be a Gap or Ser
  misc_feature (524)..(524): location 524 can be a Gap or Gly
  misc_feature (525)..(525): location 525 can be a Gap or Leu
  misc_feature (526)..(526): location 526 can be a Gap or Leu
  misc_feature (527)..(527): location 527 can be a Gap or Asp
  misc_feature (528)..(528): location 528 can be a Gap or Glu
  misc_feature (529)..(529): location 529 can be a Gap or Ala
  misc_feature (530)..(530): location 530 can be a Gap or Met
  misc_feature (531)..(531): location 531 can be a Gap or Asp
  misc_feature (532)..(532): location 532 can be a Gap or Leu
  misc_feature (533)..(533): location 533 can be a Gap or Val
  misc_feature (534)..(534): location 534 can be a Gap or Lys
  misc_feature (535)..(535): location 535 can be a Gap or Thr
  misc_feature (536)..(536): location 536 can be a Gap or Met
  misc_feature (537)..(537): location 537 can be a Gap or Pro
  misc_feature (538)..(538): location 538 can be a Gap or Met
  misc_feature (539)..(539): location 539 can be a Gap or Gln
  misc_feature (540)..(540): location 540 can be a Gap or Pro
  misc_feature (541)..(541): location 541 can be Asn or a Gap
  misc_feature (542)..(542): location 542 can be a Gap or Ser
  misc_feature (543)..(543): location 543 can be a Gap or Val
  misc_feature (544)..(544): location 544 can be Ile or a Gap
  misc_feature (545)..(545): location 545 can be a Gap or Trp
  misc_feature (546)..(546): location 546 can be a Gap or Ala
  misc_feature (547)..(547): location 547 can be a Gap or Ser
  misc_feature (548)..(548): location 548 can be Ile or a Gap
  misc_feature (549)..(549): location 549 can be a Gap or Leu
  misc_feature (550)..(550): location 550 can be a Gap or Ser
  misc_feature (551)..(551): location 551 can be a Gap or Ala
  misc_feature (552)..(552): location 552 can be a Gap or Cys
  misc_feature (553)..(553): location 553 can be a Gap or Arg
  misc_feature (554)..(554): location 554 can be a Gap or Val
  misc_feature (555)..(555): location 555 can be a Gap or His
  misc_feature (556)..(556): location 556 can be a Gap or Lys
  misc_feature (557)..(557): location 557 can be a Gap or Arg
  misc_feature (558)..(558): location 558 can be Ile or a Gap
  misc_feature (559)..(559): location 559 can be a Gap or Asp
  misc_feature (560)..(560): location 560 can be a Gap or Leu
  misc_feature (561)..(561): location 561 can be a Gap or Ala
  misc_feature (562)..(562): location 562 can be a Gap or Gln
  misc_feature (563)..(563): location 563 can be a Gap or Cys
  misc_feature (564)..(564): location 564 can be a Gap or Ala
  misc_feature (565)..(565): location 565 can be a Gap or Ala
  misc_feature (566)..(566): location 566 can be a Gap or Glu
  misc_feature (567)..(567): location 567 can be a Gap or His
  misc_feature (568)..(568): location 568 can be a Gap or Leu
  misc_feature (569)..(569): location 569 can be a Gap or Leu
  misc_feature (570)..(570): location 570 can be a Gap or Lys
  misc_feature (571)..(571): location 571 can be Ile or a Gap
  misc_feature (572)..(572): location 572 can be a Gap or Glu
  misc_feature (573)..(573): location 573 can be a Gap or Pro
  misc_feature (574)..(574): location 574 can be a Gap or Asp
  misc_feature (575)..(575): location 575 can be a Gap or Glu
  misc_feature (576)..(576): location 576 can be a Gap or Asp
  misc_feature (577)..(577): location 577 can be a Gap or Ala
  misc_feature (578)..(578): location 578 can be a Gap or Val
  misc_feature (579)..(579): location 579 can be a Gap or Tyr
  misc_feature (580)..(580): location 580 can be a Gap or Val
  misc_feature (581)..(581): location 581 can be a Gap or Gln
  misc_feature (582)..(582): location 582 can be a Gap or Leu
  misc_feature (583)..(583): location 583 can be a Gap or Tyr
  misc_feature (584)..(584): location 584 can be Asn or a Gap
  misc_feature (585)..(585): location 585 can be Ile or a Gap
  misc_feature (586)..(586): location 586 can be a Gap or Cys
  misc_feature (587)..(587): location 587 can be Ile or a Gap
  misc_feature (588)..(588): location 588 can be a Gap or Asp
  misc_feature (589)..(589): location 589 can be a Gap or Ser
  misc_feature (590)..(590): location 590 can be a Gap or Arg
  misc_feature (591)..(591): location 591 can be a Gap or Lys
  misc_feature (592)..(592): location 592 can be a Gap or Trp
  misc_feature (593)..(593): location 593 can be a Gap or Glu
  misc_feature (594)..(594): location 594 can be a Gap or Asp
  misc_feature (595)..(595): location 595 can be a Gap or Ala
  misc_feature (596)..(596): location 596 can be a Gap or Ser
  misc_feature (597)..(597): location 597 can be a Gap or Lys
  misc_feature (598)..(598): location 598 can be Ile or a Gap
  misc_feature (599)..(599): location 599 can be a Gap or Arg
  misc_feature (600)..(600): location 600 can be a Gap or Met
  misc_feature (601)..(601): location 601 can be a Gap or Leu
  misc_feature (602)..(602): location 602 can be a Gap or Met
  misc_feature (603)..(603): location 603 can be a Gap or Glu
  misc_feature (604)..(604): location 604 can be a Gap or Glu
  misc_feature (605)..(605): location 605 can be a Gap or Arg
  misc_feature (606)..(606): location 606 can be a Gap or Gln
  misc_feature (607)..(607): location 607 can be a Gap or Val
  misc_feature (608)..(608): location 608 can be a Gap or Lys
  misc_feature (609)..(609): location 609 can be a Gap or Lys
  misc_feature (610)..(610): location 610 can be a Gap or Thr
  misc_feature (611)..(611): location 611 can be a Gap or Ala
  misc_feature (612)..(612): location 612 can be a Gap or Gly
  misc_feature (613)..(613): location 613 can be a Gap or Tyr
  misc_feature (614)..(614): location 614 can be a Gap or Ser
  misc_feature (615)..(615): location 615 can be a Gap or Ser
  misc_feature (616)..(616): location 616 can be a Gap or Val
  misc_feature (617)..(617): location 617 can be a Gap or Thr
  misc_feature (618)..(618): location 618 can be a Gap or Val
  misc_feature (619)..(619): location 619 can be a Gap or Ala
  misc_feature (620)..(620): location 620 can be a Gap or Gly
  misc_feature (621)..(621): location 621 can be a Gap or Gln
  misc_feature (622)..(622): location 622 can be a Gap or Val
  misc_feature (623)..(623): location 623 can be a Gap or His
  misc_feature (624)..(624): location 624 can be a Gap or Lys
  misc_feature (625)..(625): location 625 can be a Gap or Phe
  misc_feature (626)..(626): location 626 can be a Gap or Val
  misc_feature (627)..(627): location 627 can be a Gap or Val
  misc_feature (628)..(628): location 628 can be a Gap or Ser
  misc_feature (629)..(629): location 629 can be a Gap or Asp
  misc_feature (630)..(630): location 630 can be a Gap or Lys
  misc_feature (631)..(631): location 631 can be a Gap or Ser
  misc_feature (632)..(632): location 632 can be a Gap or His
  misc_feature (633)..(633): location 633 can be a Gap or Pro
  misc_feature (634)..(634): location 634 can be a Gap or Arg
  misc_feature (635)..(635): location 635 can be Ile or a Gap
  misc_feature (636)..(636): location 636 can be a Gap or Leu
  misc_feature (637)..(637): location 637 can be a Gap or Glu
  misc_feature (638)..(638): location 638 can be Ile or a Gap
  misc_feature (639)..(639): location 639 can be Ile or a Gap
  misc_feature (640)..(640): location 640 can be a Gap or Ala
  misc_feature (641)..(641): location 641 can be a Gap or Met
  misc_feature (642)..(642): location 642 can be a Gap or Leu
  misc_feature (643)..(643): location 643 can be a Gap or Glu
  misc_feature (644)..(644): location 644 can be a Gap or Glu
  misc_feature (645)..(645): location 645 can be Ile or a Gap
  misc_feature (646)..(646): location 646 can be a Gap or Ser
  misc_feature (647)..(647): location 647 can be a Gap or His
  misc_feature (648)..(648): location 648 can be a Gap or Arg
  misc_feature (649)..(649): location 649 can be a Gap or Leu
  misc_feature (650)..(650): location 650 can be a Gap or Lys
  misc_feature (651)..(651): location 651 can be a Gap or Ser
  misc_feature (652)..(652): location 652 can be a Gap or Ala
  misc_feature (653)..(653): location 653 can be a Gap or Gly
  misc_feature (654)..(654): location 654 can be a Gap or Tyr
  misc_feature (655)..(655): location 655 can be a Gap or Ser
  misc_feature (656)..(656): location 656 can be a Gap or Pro
  misc_feature (657)..(657): location 657 can be Ile or a Gap
  misc_feature (658)..(658): location 658 can be a Gap or Thr
  misc_feature (659)..(659): location 659 can be a Gap or Ser
  misc_feature (660)..(660): location 660 can be a Gap or Gln
  misc_feature (661)..(661): location 661 can be a Gap or Val
  misc_feature (662)..(662): location 662 can be a Gap or Thr
  misc_feature (663)..(663): location 663 can be a Gap or Val
  misc_feature (664)..(664): location 664 can be a Gap or Asp
  misc_feature (665)..(665): location 665 can be a Gap or Val
  misc_feature (666)..(666): location 666 can be a Gap or Asp
  misc_feature (667)..(667): location 667 can be a Gap or Glu
  misc_feature (668)..(668): location 668 can be a Gap or Glu
  misc_feature (669)..(669): location 669 can be a Gap or Glu
  misc_feature (670)..(670): location 670 can be a Gap or Lys
  misc_feature (671)..(671): location 671 can be a Gap or Glu
  misc_feature (672)..(672): location 672 can be a Gap or Gln
  misc_feature (673)..(673): location 673 can be a Gap or Thr
  misc_feature (674)..(674): location 674 can be a Gap or Leu
  misc_feature (675)..(675): location 675 can be a Gap or Leu
  misc_feature (676)..(676): location 676 can be a Gap or Ala
  misc_feature (677)..(677): location 677 can be a Gap or His
  misc_feature (678)..(678): location 678 can be a Gap or Ser
  misc_feature (679)..(679): location 679 can be a Gap or Glu
  misc_feature (680)..(680): location 680 can be a Gap or Lys
  misc_feature (681)..(681): location 681 can be a Gap or Leu
  misc_feature (682)..(682): location 682 can be a Gap or Ala
  misc_feature (683)..(683): location 683 can be Ile or a Gap
  misc_feature (684)..(684): location 684 can be a Gap or Ala
  misc_feature (685)..(685): location 685 can be a Gap or Phe
  misc_feature (686)..(686): location 686 can be a Gap or Gly
  misc_feature (687)..(687): location 687 can be a Gap or Leu
  misc_feature (688)..(688): location 688 can be a Gap or Val
  misc_feature (689)..(689): location 689 can be a Gap or Ser
  misc_feature (690)..(690): location 690 can be a Gap or Leu
  misc_feature (691)..(691): location 691 can be a Gap or Ala
  misc_feature (692)..(692): location 692 can be a Gap or Pro
  misc_feature (693)..(693): location 693 can be Asn or a Gap
  misc_feature (694)..(694): location 694 can be a Gap or Leu
  misc_feature (695)..(695): location 695 can be a Gap or Pro
  misc_feature (696)..(696): location 696 can be a Gap or Val
  misc_feature (697)..(697): location 697 can be a Gap or His
  misc_feature (698)..(698): location 698 can be Ile or a Gap
  misc_feature (699)..(699): location 699 can be Ile or a Gap
  misc_feature (700)..(700): location 700 can be a Gap or Lys
  misc_feature (701)..(701): location 701 can be Asn or a Gap
  misc_feature (702)..(702): location 702 can be a Gap or Leu
  misc_feature (703)..(703): location 703 can be a Gap or Arg
  misc_feature (704)..(704): location 704 can be a Gap or Pro
  misc_feature (705)..(705): location 705 can be a Gap or Thr
  misc_feature (706)..(706): location 706 can be Ile or a Gap
  misc_feature (707)..(707): location 707 can be a Gap or Phe
  misc_feature (708)..(708): location 708 can be a Gap or Arg
  misc_feature (709)..(709): location 709 can be a Gap or Pro
  misc_feature (710)..(710): location 710 can be a Gap or Leu
  misc_feature (711)..(711): location 711 can be a Gap or Gly
  misc_feature (712)..(712): location 712 can be a Gap or Ala
  misc_feature (713)..(713): location 713 can be a Gap or Asp
  misc_feature (714)..(714): location 714 can be a Gap or Asp
  misc_feature (715)..(715): location 715 can be a Gap or Gly
  misc_feature (716)..(716): location 716 can be a Gap or Lys
  misc_feature (717)..(717): location 717 can be a Gap or Gln
  misc_feature (718)..(718): location 718 can be a Gap or Lys
  misc_feature (719)..(719): location 719 can be a Gap or Gln
  misc_feature (720)..(720): location 720 can be a Gap or Pro
  misc_feature (721)..(721): location 721 can be a Gap or Asp
  misc_feature (722)..(722): location 722 can be a Gap or Arg
  misc_feature (723)..(723): location 723 can be a Gap or Arg
  misc_feature (724)..(724): location 724 can be a Gap or Val
  misc_feature (725)..(725): location 725 can be a Gap or Val
  misc_feature (726)..(726): location 726 can be a Gap or Phe
  misc_feature (727)..(727): location 727 can be a Gap or Leu
  misc_feature (728)..(728): location 728 can be a Gap or Leu
  misc_feature (729)..(729): location 729 can be a Gap or Pro
  misc_feature (730)..(730): location 730 can be a Gap or Pro
  misc_feature (731)..(731): location 731 can be a Gap or Ser
  misc_feature (732)..(732): location 732 can be a Gap or Arg
  misc_feature (733)..(733): location 733 can be a Gap or Arg
  misc_feature (734)..(734): location 734 can be a Gap or Asp
  misc_feature (735)..(735): location 735 can be a Gap or Ala
  misc_feature (736)..(736): location 736 can be a Gap or Pro
  misc_feature (737)..(737): location 737 can be a Gap or Val
  misc_feature (738)..(738): location 738 can be a Gap or Leu
  misc_feature (739)..(739): location 739 can be a Gap or Val
  misc_feature (740)..(740): location 740 can be a Gap or Arg
  misc_feature (741)..(741): location 741 can be a Gap or Pro
  misc_feature (742)..(742): location 742 can be Ile or a Gap
  misc_feature (743)..(743): location 743 can be a Gap or Pro
  misc_feature (744)..(744): location 744 can be a Gap or Ser
  misc_feature (745)..(745): location 745 can be a Gap or Ser
  misc_feature (746)..(746): location 746 can be a Gap or Pro
  misc_feature (747)..(747): location 747 can be a Gap or Ala
  misc_feature (748)..(748): location 748 can be a Gap or Pro
  misc_feature (749)..(749): location 749 can be a Gap or Phe
  misc_feature (750)..(750): location 750 can be a Gap or Ser
  misc_feature (751)..(751): location 751 can be a Gap or Leu
  misc_feature (752)..(752): location 752 can be a Gap or Arg
  misc_feature (753)..(753): location 753 can be a Gap or Ser
  misc_feature (754)..(754): location 754 can be a Gap or Ser
  misc_feature (755)..(755): location 755 can be a Gap or Val
  misc_feature (756)..(756): location 756 can be a Gap or Thr
  misc_feature (757)..(757): location 757 can be a Gap or Met
  misc_feature (758)..(758): location 758 can be a Gap or Ala
  misc_feature (759)..(759): location 759 can be a Gap or Val
  misc_feature (760)..(760): location 760 can be a Gap or Arg
  misc_feature (761)..(761): location 761 can be a Gap or Asp
  misc_feature (762)..(762): location 762 can be a Gap or Val
  misc_feature (763)..(763): location 763 can be a Gap or Ala
  misc_feature (764)..(764): location 764 can be a Gap or Ser
  misc_feature (765)..(765): location 765 can be a Gap or Leu
  misc_feature (766)..(766): location 766 can be Asn or a Gap
  misc_feature (767)..(767): location 767 can be a Gap or Arg
  misc_feature (768)..(768): location 768 can be a Gap or Met
  misc_feature (769)..(769): location 769 can be Ile or a Gap
  misc_feature (770)..(770): location 770 can be a Gap or Thr
  misc_feature (771)..(771): location 771 can be a Gap or Gly
  misc_feature (772)..(772): location 772 can be a Gap or Phe
  misc_feature (773)..(773): location 773 can be Ile or a Gap
  misc_feature (774)..(774): location 774 can be a Gap or Arg
  misc_feature (775)..(775): location 775 can be a Gap or Asp
  misc_feature (776)..(776): location 776 can be a Gap or Gly
  misc_feature (777)..(777): location 777 can be a Gap or Leu
  misc_feature (778)..(778): location 778 can be a Gap or Ala
  misc_feature (779)..(779): location 779 can be a Gap or Asp
  misc_feature (780)..(780): location 780 can be a Gap or Arg
  misc_feature (781)..(781): location 781 can be a Gap or Ala
  misc_feature (782)..(782): location 782 can be a Gap or Arg
  misc_feature (783)..(783): location 783 can be a Gap or Ala
  misc_feature (784)..(784): location 784 can be a Gap or Val
  misc_feature (785)..(785): location 785 can be a Gap or Tyr
  misc_feature (786)..(786): location 786 can be a Gap or Arg
  misc_feature (787)..(787): location 787 can be a Gap or Trp
  misc_feature (788)..(788): location 788 can be a Gap or Met
  misc_feature (789)..(789): location 789 can be a Gap or Val
  misc_feature (790)..(790): location 790 can be a Gap or Ala
  misc_feature (791)..(791): location 791 can be a Gap or Ser
  misc_feature (792)..(792): location 792 can be a Gap or Gly
  misc_feature (793)..(793): location 793 can be Ile or a Gap
  misc_feature (794)..(794): location 794 can be a Gap or Arg
  misc_feature (795)..(795): location 795 can be a Gap or Glu
  misc_feature (796)..(796): location 796 can be a Gap or Thr
  misc_feature (797)..(797): location 797 can be a Gap or Pro
  misc_feature (798)..(798): location 798 can be a Gap or His
  misc_feature (799)..(799): location 799 can be a Gap or Thr
  misc_feature (800)..(800): location 800 can be a Gap or Phe
  misc_feature (801)..(801): location 801 can be a Gap or Ser
  misc_feature (802)..(802): location 802 can be a Gap or Thr
  misc_feature (803)..(803): location 803 can be Ile or a Gap
  misc_feature (804)..(804): location 804 can be a Gap or Leu
  misc_feature (805)..(805): location 805 can be a Gap or Gly
  misc_feature (806)..(806): location 806 can be a Gap or Val
  misc_feature (807)..(807): location 807 can be a Gap or Cys
  misc_feature (808)..(808): location 808 can be a Gap or Ser
  misc_feature (809)..(809): location 809 can be a Gap or Thr
  misc_feature (810)..(810): location 810 can be a Gap or Tyr
  misc_feature (811)..(811): location 811 can be a Gap or Glu
  misc_feature (812)..(812): location 812 can be a Gap or Ala
  misc_feature (813)..(813): location 813 can be a Gap or Leu
  misc_feature (814)..(814): location 814 can be a Gap or Gln
  misc_feature (815)..(815): location 815 can be a Gap or Leu
  misc_feature (816)..(816): location 816 can be a Gap or His
  misc_feature (817)..(817): location 817 can be a Gap or Gly
  misc_feature (818)..(818): location 818 can be a Gap or Arg
  misc_feature (819)..(819): location 819 can be a Gap or Val
  misc_feature (820)..(820): location 820 can be a Gap or Leu
  misc_feature (821)..(821): location 821 can be a Gap or Ala
  misc_feature (822)..(822): location 822 can be a Gap or Leu
  misc_feature (823)..(823): location 823 can be a Gap or Gly
  misc_feature (824)..(824): location 824 can be a Gap or Leu
  misc_feature (825)..(825): location 825 can be a Gap or Cys
  misc_feature (826)..(826): location 826 can be a Gap or Cys
  misc_feature (827)..(827): location 827 can be Asn or a Gap
  misc_feature (828)..(828): location 828 can be a Gap or Pro
  misc_feature (829)..(829): location 829 can be a Gap or Phe
  misc_feature (830)..(830): location 830 can be a Gap or Val
  misc_feature (831)..(831): location 831 can be a Gap or Gly
  misc_feature (832)..(832): location 832 can be a Gap or Ser
  misc_feature (833)..(833): location 833 can be a Gap or Ala
  misc_feature (834)..(834): location 834 can be a Gap or Leu
  misc_feature (835)..(835): location 835 can be a Gap or Val
  misc_feature (836)..(836): location 836 can be Asn or a Gap
  misc_feature (837)..(837): location 837 can be a Gap or His
  misc_feature (838)..(838): location 838 can be a Gap or Tyr
  misc_feature (839)..(839): location 839 can be a Gap or Met
  misc_feature (840)..(840): location 840 can be a Gap or His
  misc_feature (841)..(841): location 841 can be a Gap or Val
  misc_feature (842)..(842): location 842 can be a Gap or Glu
  misc_feature (843)..(843): location 843 can be a Gap or Ser
  misc_feature (844)..(844): location 844 can be a Gap or Pro
  misc_feature (845)..(845): location 845 can be a Gap or His
  misc_feature (846)..(846): location 846 can be a Gap or Ala
  misc_feature (847)..(847): location 847 can be a Gap or Ala
  misc_feature (848)..(848): location 848 can be a Gap or Leu
  misc_feature (849)..(849): location 849 can be a Gap or Ser
  misc_feature (850)..(850): location 850 can be a Gap or Leu
  misc_feature (851)..(851): location 851 can be a Gap or Phe
  misc_feature (852)..(852): location 852 can be a Gap or Arg
  misc_feature (853)..(853): location 853 can be a Gap or Glu
  misc_feature (854)..(854): location 854 can be a Gap or Leu
  misc_feature (855)..(855): location 855 can be a Gap or Pro
  misc_feature (856)..(856): location 856 can be a Gap or Leu
  misc_feature (857)..(857): location 857 can be a Gap or Gln
  misc_feature (858)..(858): location 858 can be Asn or a Gap
  misc_feature (859)..(859): location 859 can be a Gap or Thr
  misc_feature (860)..(860): location 860 can be a Gap or Ala
  misc_feature (861)..(861): location 861 can be a Gap or Met
  misc_feature (862)..(862): location 862 can be a Gap or Cys
  misc_feature (863)..(863): location 863 can be Asn or a Gap
  misc_feature (864)..(864): location 864 can be a Gap or Val
  misc_feature (865)..(865): location 865 can be a Gap or Val
  misc_feature (866)..(866): location 866 can be a Gap or Leu
  misc_feature (867)..(867): location 867 can be a Gap or Arg
  misc_feature (868)..(868): location 868 can be a Gap or Gly
  misc_feature (869)..(869): location 869 can be a Gap or Leu
  misc_feature (870)..(870): location 870 can be a Gap or Gly
  misc_feature (871)..(871): location 871 can be Asn or a Gap
  misc_feature (872)..(872): location 872 can be a Gap or Leu
  misc_feature (873)..(873): location 873 can be a Gap or Lys
  misc_feature (874)..(874): location 874 can be a Gap or Leu
  misc_feature (875)..(875): location 875 can be a Gap or Thr
  misc_feature (876)..(876): location 876 can be a Gap or Glu
  misc_feature (877)..(877): location 877 can be a Gap or Glu
  misc_feature (878)..(878): location 878 can be a Gap or Leu
  misc_feature (879)..(879): location 879 can be Ile or a Gap
  misc_feature (880)..(880): location 880 can be a Gap or Cys
  misc_feature (881)..(881): location 881 can be a Gap or Cys
  misc_feature (882)..(882): location 882 can be a Gap or Phe
  misc_feature (883)..(883): location 883 can be a Gap or Leu
  misc_feature (884)..(884): location 884 can be a Gap or Asp
  misc_feature (885)..(885): location 885 can be a Gap or Met
  misc_feature (886)..(886): location 886 can be a Gap or Arg
  misc_feature (887)..(887): location 887 can be a Gap or Arg
  misc_feature (888)..(888): location 888 can be a Gap or Gln
  misc_feature (889)..(889): location 889 can be a Gap or Tyr
  misc_feature (890)..(890): location 890 can be a Gap or Leu
  misc_feature (891)..(891): location 891 can be a Gap or Glu
  misc_feature (892)..(892): location 892 can be a Gap or Leu
  misc_feature (893)..(893): location 893 can be Asn or a Gap
  misc_feature (894)..(894): location 894 can be a Gap or Gly
  misc_feature (895)..(895): location 895 can be a Gap or Leu
  misc_feature (896)..(896): location 896 can be a Gap or Ser
  misc_feature (897)..(897): location 897 can be a Gap or Tyr
  misc_feature (898)..(898): location 898 can be a Gap or Cys
  misc_feature (899)..(899): location 899 can be a Gap or Tyr
  misc_feature (900)..(900): location 900 can be a Gap or Ala
  misc_feature (901)..(901): location 901 can be a Gap or Met
  misc_feature (902)..(902): location 902 can be a Gap or Lys
  misc_feature (903)..(903): location 903 can be a Gap or Gly
  misc_feature (904)..(904): location 904 can be a Gap or Cys
  misc_feature (905)..(905): location 905 can be a Gap or Tyr
  misc_feature (906)..(906): location 906 can be a Gap or Gln
  misc_feature (907)..(907): location 907 can be Asn or a Gap
  misc_feature (908)..(908): location 908 can be a Gap or Gly
  misc_feature (909)..(909): location 909 can be a Gap or Glu
  misc_feature (910)..(910): location 910 can be a Gap or Trp
  misc_feature (911)..(911): location 911 can be a Gap or Leu
  misc_feature (912)..(912): location 912 can be a Gap or Glu
  misc_feature (913)..(913): location 913 can be a Gap or Gln
  misc_feature (914)..(914): location 914 can be a Gap or Gly
  misc_feature (915)..(915): location 915 can be a Gap or Arg
  misc_feature (916)..(916): location 916 can be a Gap or Gln
  misc_feature (917)..(917): location 917 can be a Gap or Leu
  misc_feature (918)..(918): location 918 can be a Gap or His
  misc_feature (919)..(919): location 919 can be a Gap or Gly
  misc_feature (920)..(920): location 920 can be a Gap or Val
  misc_feature (921)..(921): location 921 can be a Gap or Val
  misc_feature (922)..(922): location 922 can be a Gap or Leu
  misc_feature (923)..(923): location 923 can be a Gap or Lys
  misc_feature (924)..(924): location 924 can be a Gap or Ala
  misc_feature (925)..(925): location 925 can be a Gap or Gly
  misc_feature (926)..(926): location 926 can be a Gap or Trp
  misc_feature (927)..(927): location 927 can be Ile or a Gap
  misc_feature (928)..(928): location 928 can be a Gap or Pro
  misc_feature (929)..(929): location 929 can be a Gap or Ser
  misc_feature (930)..(930): location 930 can be Asn or a Gap
  misc_feature (931)..(931): location 931 can be Ile or a Gap
  misc_feature (932)..(932): location 932 can be a Gap or Phe
  misc_feature (933)..(933): location 933 can be a Gap or Leu
  misc_feature (934)..(934): location 934 can be a Gap or Ser
  misc_feature (935)..(935): location 935 can be Asn or a Gap
  misc_feature (936)..(936): location 936 can be a Gap or Ser
  misc_feature (937)..(937): location 937 can be a Gap or Leu
  misc_feature (938)..(938): location 938 can be a Gap or Val
  misc_feature (939)..(939): location 939 can be a Gap or Asp
  misc_feature (940)..(940): location 940 can be a Gap or Leu
  misc_feature (941)..(941): location 941 can be a Gap or Tyr
  misc_feature (942)..(942): location 942 can be a Gap or Ser
  misc_feature (943)..(943): location 943 can be a Gap or Ala
  misc_feature (944)..(944): location 944 can be Ile or a Gap
  misc_feature (945)..(945): location 945 can be a Gap or Gly
  misc_feature (946)..(946): location 946 can be a Gap or Asp
  misc_feature (947)..(947): location 947 can be a Gap or Ser
  misc_feature (948)..(948): location 948 can be a Gap or Val
  misc_feature (949)..(949): location 949 can be a Gap or Asp
  misc_feature (950)..(950): location 950 can be a Gap or Thr
  misc_feature (951)..(951): location 951 can be a Gap or Val
  misc_feature (952)..(952): location 952 can be a Gap or Lys
  misc_feature (953)..(953): location 953 can be a Gap or Ala
  misc_feature (954)..(954): location 954 can be a Gap or Leu
  misc_feature (955)..(955): location 955 can be Asn or a Gap
  misc_feature (956)..(956): location 956 can be a Gap or Asp
  misc_feature (957)..(957): location 957 can be Ile or a Gap
  misc_feature (958)..(958): location 958 can be a Gap or Leu
  misc_feature (959)..(959): location 959 can be a Gap or Ser
  misc_feature (960)..(960): location 960 can be a Gap or Glu
  misc_feature (961)..(961): location 961 can be a Gap or Asp
  misc_feature (962)..(962): location 962 can be a Gap or Val
  misc_feature (963)..(963): location 963 can be Ile or a Gap
  misc_feature (964)..(964): location 964 can be a Gap or Ser
  misc_feature (965)..(965): location 965 can be a Gap or Trp
  misc_feature (966)..(966): location 966 can be Asn or a Gap
  misc_feature (967)..(967): location 967 can be a Gap or Ser
  misc_feature (968)..(968): location 968 can be Ile or a Gap
  misc_feature (969)..(969): location 969 can be a Gap or Leu
  misc_feature (970)..(970): location 970 can be a Gap or Ser
  misc_feature (971)..(971): location 971 can be a Gap or Met
  misc_feature (972)..(972): location 972 can be a Gap or Tyr
  misc_feature (973)..(973): location 973 can be a Gap or Ala
  misc_feature (974)..(974): location 974 can be a Gap or Asp
  misc_feature (975)..(975): location 975 can be a Gap or Arg
  misc_feature (976)..(976): location 976 can be a Gap or Gly
  misc_feature (977)..(977): location 977 can be a Gap or His
  misc_feature (978)..(978): location 978 can be a Gap or Met
  misc_feature (979)..(979): location 979 can be a Gap or Lys
  misc_feature (980)..(980): location 980 can be a Gap or Glu
  misc_feature (981)..(981): location 981 can be a Gap or Ala
  misc_feature (982)..(982): location 982 can be a Gap or Val
  misc_feature (983)..(983): location 983 can be a Gap or Tyr
  misc_feature (984)..(984): location 984 can be a Gap or Tyr
  misc_feature (985)..(985): location 985 can be a Gap or Leu
  misc_feature (986)..(986): location 986 can be a Gap or Lys
  misc_feature (987)..(987): location 987 can be a Gap or Gln
  misc_feature (988)..(988): location 988 can be a Gap or Met
  misc_feature (989)..(989): location 989 can be a Gap or Leu
  misc_feature (990)..(990): location 990 can be a Gap or Trp
  misc_feature (991)..(991): location 991 can be a Gap or His
  misc_feature (992)..(992): location 992 can be a Gap or Gly
  misc_feature (993)..(993): location 993 can be a Gap or Lys
  misc_feature (994)..(994): location 994 can be a Gap or Met
  misc_feature (995)..(995): location 995 can be a Gap or Pro
  misc_feature (996)..(996): location 996 can be a Gap or Ser
  misc_feature (997)..(997): location 997 can be a Gap or Val
  misc_feature (998)..(998): location 998 can be a Gap or Arg
  misc_feature (999)..(999): location 999 can be a Gap or Ser
  misc_feature (1000)..(1000): location 1000 can be a Gap or Phe
  misc_feature (1001)..(1001): location 1001 can be a Gap or Val
  misc_feature (1002)..(1002): location 1002 can be a Gap or Ser
  misc_feature (1003)..(1003): location 1003 can be a Gap or Leu
  misc_feature (1004)..(1004): location 1004 can be a Gap or Leu
  misc_feature (1005)..(1005): location 1005 can be a Gap or Ala
  misc_feature (1006)..(1006): location 1006 can be a Gap or Leu
  misc_feature (1007)..(1007): location 1007 can be a Gap or Ser
  misc_feature (1008)..(1008): location 1008 can be a Gap or Gly
  misc_feature (1009)..(1009): location 1009 can be a Gap or Lys
  misc_feature (1010)..(1010): location 1010 can be a Gap or Thr
  misc_feature (1011)..(1011): location 1011 can be a Gap or Gly
  misc_feature (1012)..(1012): location 1012 can be a Gap or Asp
  misc_feature (1013)..(1013): location 1013 can be a Gap or Trp
  misc_feature (1014)..(1014): location 1014 can be a Gap or Gln
  misc_feature (1015)..(1015): location 1015 can be a Gap or Leu
  misc_feature (1016)..(1016): location 1016 can be a Gap or Gly
  misc_feature (1017)..(1017): location 1017 can be a Gap or Val
  misc_feature (1018)..(1018): location 1018 can be a Gap or Gln
  misc_feature (1019)..(1019): location 1019 can be Ile or a Gap
  misc_feature (1020)..(1020): location 1020 can be a Gap or His
  misc_feature (1021)..(1021): location 1021 can be a Gap or Gly
  misc_feature (1022)..(1022): location 1022 can be Ile or a Gap
  misc_feature (1023)..(1023): location 1023 can be a Gap or Val
  misc_feature (1024)..(1024): location 1024 can be a Gap or His
  misc_feature (1025)..(1025): location 1025 can be a Gap or Lys
  misc_feature (1026)..(1026): location 1026 can be a Gap or Leu
  misc_feature (1027)..(1027): location 1027 can be a Gap or Gly
  misc_feature (1028)..(1028): location 1028 can be a Gap or Phe
  misc_feature (1029)..(1029): location 1029 can be a Gap or Ser
  misc_feature (1030)..(1030): location 1030 can be a Gap or Cys
  misc_feature (1031)..(1031): location 1031 can be a Gap or Ser
  misc_feature (1032)..(1032): location 1032 can be a Gap or Ser
  misc_feature (1033)..(1033): location 1033 can be a Gap or Val
  misc_feature (1034)..(1034): location 1034 can be a Gap or His
  misc_feature (1035)..(1035): location 1035 can be a Gap or Val
  misc_feature (1036)..(1036): location 1036 can be a Gap or Gln
  misc_feature (1037)..(1037): location 1037 can be a Gap or Thr
  misc_feature (1038)..(1038): location 1038 can be a Gap or Thr
  misc_feature (1039)..(1039): location 1039 can be a Gap or Leu
  misc_feature (1040)..(1040): location 1040 can be Ile or a Gap
  misc_feature (1041)..(1041): location 1041 can be a Gap or Asp
  misc_feature (1042)..(1042): location 1042 can be a Gap or Met
  misc_feature (1043)..(1043): location 1043 can be a Gap or Tyr
  misc_feature (1044)..(1044): location 1044 can be a Gap or Gly
  misc_feature (1045)..(1045): location 1045 can be a Gap or Lys
  misc_feature (1046)..(1046): location 1046 can be a Gap or Cys
  misc_feature (1047)..(1047): location 1047 can be a Gap or Cys
  misc_feature (1048)..(1048): location 1048 can be a Gap or Cys
  misc_feature (1049)..(1049): location 1049 can be a Gap or Phe
  misc_feature (1050)..(1050): location 1050 can be a Gap or Asp
  misc_feature (1051)..(1051): location 1051 can be a Gap or His
  misc_feature (1052)..(1052): location 1052 can be a Gap or Ser
  misc_feature (1053)..(1053): location 1053 can be a Gap or Leu
  misc_feature (1054)..(1054): location 1054 can be a Gap or Ala
  misc_feature (1055)..(1055): location 1055 can be Ile or a Gap
  misc_feature (1056)..(1056): location 1056 can be a Gap or Phe
  misc_feature (1057)..(1057): location 1057 can be Asn or a Gap
  misc_feature (1058)..(1058): location 1058 can be a Gap or Glu
  misc_feature (1059)..(1059): location 1059 can be Ile or a Gap
  misc_feature (1060)..(1060): location 1060 can be a Gap or Pro
  misc_feature (1061)..(1061): location 1061 can be a Gap or Ser
  misc_feature (1062)..(1062): location 1062 can be Ile or a Gap
  misc_feature (1063)..(1063): location 1063 can be a Gap or Ala
  misc_feature (1064)..(1064): location 1064 can be a Gap or Leu
  misc_feature (1065)..(1065): location 1065 can be a Gap or Glu
  misc_feature (1066)..(1066): location 1066 can be a Gap or Cys
  misc_feature (1067)..(1067): location 1067 can be a Gap or Cys
  misc_feature (1068)..(1068): location 1068 can be Asn or a Gap
  misc_feature (1069)..(1069): location 1069 can be a Gap or Ser
  misc_feature (1070)..(1070): location 1070 can be a Gap or Leu
  misc_feature (1071)..(1071): location 1071 can be Ile or a Gap
  misc_feature (1072)..(1072): location 1072 can be a Gap or Thr
  misc_feature (1073)..(1073): location 1073 can be a Gap or Ser
  misc_feature (1074)..(1074): location 1074 can be a Gap or Ser
  misc_feature (1075)..(1075): location 1075 can be a Gap or Leu
  misc_feature (1076)..(1076): location 1076 can be a Gap or Gly
  misc_feature (1077)..(1077): location 1077 can be a Gap or Cys
  misc_feature (1078)..(1078): location 1078 can be Asn or a Gap
  misc_feature (1079)..(1079): location 1079 can be a Gap or Met
  misc_feature (1080)..(1080): location 1080 can be a Gap or Phe
  misc_feature (1081)..(1081): location 1081 can be a Gap or Asp
  misc_feature (1082)..(1082): location 1082 can be a Gap or Ala
  misc_feature (1083)..(1083): location 1083 can be a Gap or Ala
  misc_feature (1084)..(1084): location 1084 can be a Gap or Leu
  misc_feature (1085)..(1085): location 1085 can be a Gap or Glu
  misc_feature (1086)..(1086): location 1086 can be Ile or a Gap
  misc_feature (1087)..(1087): location 1087 can be a Gap or Leu
  misc_feature (1088)..(1088): location 1088 can be a Gap or His
  misc_feature (1089)..(1089): location 1089 can be a Gap or Cys
  misc_feature (1090)..(1090): location 1090 can be a Gap or Met
  misc_feature (1091)..(1091): location 1091 can be Ile or a Gap
  misc_feature (1092)..(1092): location 1092 can be a Gap or Val
  misc_feature (1093)..(1093): location 1093 can be a Gap or Glu
  misc_feature (1094)..(1094): location 1094 can be a Gap or Gly
  misc_feature (1095)..(1095): location 1095 can be a Gap or Val
  misc_feature (1096)..(1096): location 1096 can be a Gap or Thr
  misc_feature (1097)..(1097): location 1097 can be a Gap or Pro
  misc_feature (1098)..(1098): location 1098 can be a Gap or Asp
  misc_feature (1099)..(1099): location 1099 can be a Gap or Asp
  misc_feature (1100)..(1100): location 1100 can be a Gap or Val
  misc_feature (1101)..(1101): location 1101 can be a Gap or Thr
  misc_feature (1102)..(1102): location 1102 can be a Gap or Phe
  misc_feature (1103)..(1103): location 1103 can be a Gap or Ser
  misc_feature (1104)..(1104): location 1104 can be a Gap or Ala
  misc_feature (1105)..(1105): location 1105 can be a Gap or Thr
  misc_feature (1106)..(1106): location 1106 can be a Gap or Met
  misc_feature (1107)..(1107): location 1107 can be a Gap or Lys
  misc_feature (1108)..(1108): location 1108 can be a Gap or Ala
  misc_feature (1109)..(1109): location 1109 can be Ile or a Gap
  misc_feature (1110)..(1110): location 1110 can be a Gap or Ser
  misc_feature (1111)..(1111): location 1111 can be a Gap or Leu
  misc_feature (1112)..(1112): location 1112 can be a Gap or Ser
  misc_feature (1113)..(1113): location 1113 can be a Gap or Ala
  misc_feature (1114)..(1114): location 1114 can be a Gap or Ser
  misc_feature (1115)..(1115): location 1115 can be a Gap or Pro
  misc_feature (1116)..(1116): location 1116 can be a Gap or Ser
  misc_feature (1117)..(1117): location 1117 can be a Gap or Leu
  misc_feature (1118)..(1118): location 1118 can be a Gap or Thr
  misc_feature (1119)..(1119): location 1119 can be a Gap or Ser
  misc_feature (1120)..(1120): location 1120 can be a Gap or Cys
  misc_feature (1121)..(1121): location 1121 can be a Gap or Gln
  misc_feature (1122)..(1122): location 1122 can be a Gap or Met
  misc_feature (1123)..(1123): location 1123 can be a Gap or Leu
  misc_feature (1124)..(1124): location 1124 can be a Gap or His
  misc_feature (1125)..(1125): location 1125 can be a Gap or Ser
  misc_feature (1126)..(1126): location 1126 can be a Gap or Cys
  misc_feature (1127)..(1127): location 1127 can be a Gap or Leu
  misc_feature (1128)..(1128): location 1128 can be a Gap or Val
  misc_feature (1129)..(1129): location 1129 can be a Gap or Lys
  misc_feature (1130)..(1130): location 1130 can be a Gap or Leu
  misc_feature (1131)..(1131): location 1131 can be a Gap or Gly
  misc_feature (1132)..(1132): location 1132 can be a Gap or Phe
  misc_feature (1133)..(1133): location 1133 can be a Gap or Glu
  misc_feature (1134)..(1134): location 1134 can be a Gap or Met
  misc_feature (1135)..(1135): location 1135 can be a Gap or Asp
  misc_feature (1136)..(1136): location 1136 can be a Gap or Met
  misc_feature (1137)..(1137): location 1137 can be a Gap or Ala
  misc_feature (1138)..(1138): location 1138 can be a Gap or Val
  misc_feature (1139)..(1139): location 1139 can be a Gap or Cys
  misc_feature (1140)..(1140): location 1140 can be a Gap or Ser
  misc_feature (1141)..(1141): location 1141 can be a Gap or Ser
  misc_feature (1142)..(1142): location 1142 can be a Gap or Leu
  misc_feature (1143)..(1143): location 1143 can be Ile or a Gap
  misc_feature (1144)..(1144): location 1144 can be a Gap or Thr
  misc_feature (1145)..(1145): location 1145 can be a Gap or Ala
  misc_feature (1146)..(1146): location 1146 can be a Gap or Tyr
  misc_feature (1147)..(1147): location 1147 can be a Gap or Ala
  misc_feature (1148)..(1148): location 1148 can be a Gap or Cys
  misc_feature (1149)..(1149): location 1149 can be a Gap or Ala
  misc_feature (1150)..(1150): location 1150 can be a Gap or Gly
  misc_feature (1151)..(1151): location 1151 can be a Gap or Gln
  misc_feature (1152)..(1152): location 1152 can be a Gap or Leu
  misc_feature (1153)..(1153): location 1153 can be a Gap or Ser
  misc_feature (1154)..(1154): location 1154 can be a Gap or Ser
  misc_feature (1155)..(1155): location 1155 can be a Gap or Ser
  misc_feature (1156)..(1156): location 1156 can be a Gap or His
  misc_feature (1157)..(1157): location 1157 can be a Gap or Leu
  misc_feature (1158)..(1158): location 1158 can be Ile or a Gap
  misc_feature (1159)..(1159): location 1159 can be a Gap or Phe
  misc_feature (1160)..(1160): location 1160 can be a Gap or Glu
  misc_feature (1161)..(1161): location 1161 can be a Gap or Gly
  misc_feature (1162)..(1162): location 1162 can be a Gap or Leu
  misc_feature (1163)..(1163): location 1163 can be a Gap or Leu
  misc_feature (1164)..(1164): location 1164 can be a Gap or Asp
  misc_feature (1165)..(1165): location 1165 can be a Gap or Pro
  misc_feature (1166)..(1166): location 1166 can be Asn or a Gap
  misc_feature (1167)..(1167): location 1167 can be a Gap or Val
  misc_feature (1168)..(1168): location 1168 can be Ile or a Gap
  misc_feature (1169)..(1169): location 1169 can be a Gap or Cys
  misc_feature (1170)..(1170): location 1170 can be a Gap or Phe
  misc_feature (1171)..(1171): location 1171 can be a Gap or Thr
  misc_feature (1172)..(1172): location 1172 can be a Gap or Ala
  misc_feature (1173)..(1173): location 1173 can be Ile or a Gap
  misc_feature (1174)..(1174): location 1174 can be Ile or a Gap
  misc_feature (1175)..(1175): location 1175 can be a Gap or Ser
  misc_feature (1176)..(1176): location 1176 can be a Gap or Ala
  misc_feature (1177)..(1177): location 1177 can be a Gap or Cys
  misc_feature (1178)..(1178): location 1178 can be a Gap or Ala
  misc_feature (1179)..(1179): location 1179 can be a Gap or Arg
  misc_feature (1180)..(1180): location 1180 can be a Gap or Tyr
  misc_feature (1181)..(1181): location 1181 can be a Gap or Gly
  misc_feature (1182)..(1182): location 1182 can be a Gap or Asp
  misc_feature (1183)..(1183): location 1183 can be a Gap or Gly
  misc_feature (1184)..(1184): location 1184 can be a Gap or Ala
  misc_feature (1185)..(1185): location 1185 can be a Gap or Arg
  misc_feature (1186)..(1186): location 1186 can be a Gap or Ala
  misc_feature (1187)..(1187): location 1187 can be a Gap or Met
  misc_feature (1188)..(1188): location 1188 can be a Gap or Glu
  misc_feature (1189)..(1189): location 1189 can be a Gap or Leu
  misc_feature (1190)..(1190): location 1190 can be a Gap or Phe
  misc_feature (1191)..(1191): location 1191 can be a Gap or Asp
  misc_feature (1192)..(1192): location 1192 can be a Gap or Gln
  misc_feature (1193)..(1193): location 1193 can be a Gap or Met
  misc_feature (1194)..(1194): location 1194 can be a Gap or Val
  misc_feature (1195)..(1195): location 1195 can be a Gap or Ser
  misc_feature (1196)..(1196): location 1196 can be a Gap or Ser
  misc_feature (1197)..(1197): location 1197 can be a Gap or Gly
  misc_feature (1198)..(1198): location 1198 can be a Gap or Leu
  misc_feature (1199)..(1199): location 1199 can be a Gap or Lys
  misc_feature (1200)..(1200): location 1200 can be a Gap or Pro
  misc_feature (1201)..(1201): location 1201 can be a Gap or Asp
  misc_feature (1202)..(1202): location 1202 can be Asn or a Gap
  misc_feature (1203)..(1203): location 1203 can be a Gap or Val
  misc_feature (1204)..(1204): location 1204 can be a Gap or Thr
  misc_feature (1205)..(1205): location 1205 can be a Gap or Phe
  misc_feature (1206)..(1206): location 1206 can be a Gap or Leu
  misc_feature (1207)..(1207): location 1207 can be a Gap or Cys
  misc_feature (1208)..(1208): location 1208 can be a Gap or Ala
  misc_feature (1209)..(1209): location 1209 can be Ile or a Gap
  misc_feature (1210)..(1210): location 1210 can be a Gap or Ala
  misc_feature (1211)..(1211): location 1211 can be a Gap or Gly
  misc_feature (1212)..(1212): location 1212 can be a Gap or Cys
  misc_feature (1213)..(1213): location 1213 can be a Gap or Asp
  misc_feature (1214)..(1214): location 1214 can be a Gap or Gln
  misc_feature (1215)..(1215): location 1215 can be a Gap or Ala
  misc_feature (1216)..(1216): location 1216 can be a Gap or Gly
  misc_feature (1217)..(1217): location 1217 can be a Gap or Met
  misc_feature (1218)..(1218): location 1218 can be a Gap or Phe
  misc_feature (1219)..(1219): location 1219 can be a Gap or Glu
  misc_feature (1220)..(1220): location 1220 can be a Gap or Glu
  misc_feature (1221)..(1221): location 1221 can be a Gap or Gly
  misc_feature (1222)..(1222): location 1222 can be a Gap or Arg
  misc_feature (1223)..(1223): location 1223 can be a Gap or Leu
  misc_feature (1224)..(1224): location 1224 can be a Gap or Val
  misc_feature (1225)..(1225): location 1225 can be Ile or a Gap
  misc_feature (1226)..(1226): location 1226 can be a Gap or Glu
  misc_feature (1227)..(1227): location 1227 can be a Gap or Leu
  misc_feature (1228)..(1228): location 1228 can be a Gap or Met
  misc_feature (1229)..(1229): location 1229 can be a Gap or Arg
  misc_feature (1230)..(1230): location 1230 can be a Gap or Ala
  misc_feature (1231)..(1231): location 1231 can be a Gap or Ser
  misc_feature (1232)..(1232): location 1232 can be a Gap or Arg
  misc_feature (1233)..(1233): location 1233 can be a Gap or Glu
  misc_feature (1234)..(1234): location 1234 can be a Gap or Leu
  misc_feature (1235)..(1235): location 1235 can be a Gap or Asp
  misc_feature (1236)..(1236): location 1236 can be a Gap or Pro
  misc_feature (1237)..(1237): location 1237 can be a Gap or Asp
  misc_feature (1238)..(1238): location 1238 can be a Gap or Glu
  misc_feature (1239)..(1239): location 1239 can be a Gap or Arg
  misc_feature (1240)..(1240): location 1240 can be a Gap or His
  misc_feature (1241)..(1241): location 1241 can be a Gap or Phe
  misc_feature (1242)..(1242): location 1242 can be a Gap or Ala
  misc_feature (1243)..(1243): location 1243 can be a Gap or Cys
  misc_feature (1244)..(1244): location 1244 can be a Gap or Met
  misc_feature (1245)..(1245): location 1245 can be a Gap or Val
  misc_feature (1246)..(1246): location 1246 can be Asn or a Gap
  misc_feature (1247)..(1247): location 1247 can be a Gap or Leu
  misc_feature (1248)..(1248): location 1248 can be a Gap or Leu
  misc_feature (1249)..(1249): location 1249 can be a Gap or Ser
  misc_feature (1250)..(1250): location 1250 can be a Gap or Arg
  misc_feature (1251)..(1251): location 1251 can be a Gap or Asp
  misc_feature (1252)..(1252): location 1252 can be a Gap or Gly
  misc_feature (1253)..(1253): location 1253 can be a Gap or Phe
  misc_feature (1254)..(1254): location 1254 can be a Gap or Val
  misc_feature (1255)..(1255): location 1255 can be a Gap or Lys
  misc_feature (1256)..(1256): location 1256 can be a Gap or Glu
  misc_feature (1257)..(1257): location 1257 can be a Gap or Ala
  misc_feature (1258)..(1258): location 1258 can be a Gap or Met
  misc_feature (1259)..(1259): location 1259 can be a Gap or Glu
  misc_feature (1260)..(1260): location 1260 can be a Gap or Met
  misc_feature (1261)..(1261): location 1261 can be a Gap or Met
  misc_feature (1262)..(1262): location 1262 can be a Gap or Glu
  misc_feature (1263)..(1263): location 1263 can be a Gap or Gln
  misc_feature (1264)..(1264): location 1264 can be a Gap or Ser
  misc_feature (1265)..(1265): location 1265 can be a Gap or Pro
  misc_feature (1266)..(1266): location 1266 can be a Gap or Leu
  misc_feature (1267)..(1267): location 1267 can be a Gap or Arg
  misc_feature (1268)..(1268): location 1268 can be a Gap or His
  misc_feature (1269)..(1269): location 1269 can be a Gap or Tyr
  misc_feature (1270)..(1270): location 1270 can be a Gap or Thr
  misc_feature (1271)..(1271): location 1271 can be a Gap or Lys
  misc_feature (1272)..(1272): location 1272 can be a Gap or Ala
  misc_feature (1273)..(1273): location 1273 can be a Gap or Trp
  misc_feature (1274)..(1274): location 1274 can be a Gap or Ser
  misc_feature (1275)..(1275): location 1275 can be a Gap or Ser
  misc_feature (1276)..(1276): location 1276 can be a Gap or Leu
  misc_feature (1277)..(1277): location 1277 can be a Gap or Leu
  misc_feature (1278)..(1278): location 1278 can be a Gap or Gln
  misc_feature (1279)..(1279): location 1279 can be a Gap or Ser
  misc_feature (1280)..(1280): location 1280 can be a Gap or Cys
  misc_feature (1281)..(1281): location 1281 can be a Gap or Lys
  misc_feature (1282)..(1282): location 1282 can be a Gap or Ala
  misc_feature (1283)..(1283): location 1283 can be a Gap or His
  misc_feature (1284)..(1284): location 1284 can be a Gap or Gly
  misc_feature (1285)..(1285): location 1285 can be a Gap or Glu
  misc_feature (1286)..(1286): location 1286 can be Asn or a Gap
  misc_feature (1287)..(1287): location 1287 can be a Gap or Val
  misc_feature (1288)..(1288): location 1288 can be a Gap or Leu
  misc_feature (1289)..(1289): location 1289 can be a Gap or Gly
  misc_feature (1290)..(1290): location 1290 can be a Gap or Lys
  misc_feature (1291)..(1291): location 1291 can be a Gap or Arg
  misc_feature (1292)..(1292): location 1292 can be a Gap or Ala
  misc_feature (1293)..(1293): location 1293 can be a Gap or Ala
  misc_feature (1294)..(1294): location 1294 can be Asn or a Gap
  misc_feature (1295)..(1295): location 1295 can be a Gap or Met
  misc_feature (1296)..(1296): location 1296 can be a Gap or Leu
  misc_feature (1297)..(1297): location 1297 can be Ile or a Gap
  misc_feature (1298)..(1298): location 1298 can be a Gap or Asp
  misc_feature (1299)..(1299): location 1299 can be a Gap or Val
  misc_feature (1300)..(1300): location 1300 can be a Gap or Gly
  misc_feature (1301)..(1301): location 1301 can be a Gap or Arg
  misc_feature (1302)..(1302): location 1302 can be a Gap or Lys
  misc_feature (1303)..(1303): location 1303 can be a Gap or Asp
  misc_feature (1304)..(1304): location 1304 can be a Gap or Pro
  misc_feature (1305)..(1305): location 1305 can be a Gap or Ala
  misc_feature (1306)..(1306): location 1306 can be a Gap or Thr
  misc_feature (1307)..(1307): location 1307 can be a Gap or Thr
  misc_feature (1308)..(1308): location 1308 can be a Gap or Leu
  misc_feature (1309)..(1309): location 1309 can be a Gap or Gln
  misc_feature (1310)..(1310): location 1310 can be a Gap or Val
  misc_feature (1311)..(1311): location 1311 can be a Gap or Ser
  misc_feature (1312)..(1312): location 1312 can be Asn or a Gap
  misc_feature (1313)..(1313): location 1313 can be a Gap or Phe
  misc_feature (1314)..(1314): location 1314 can be a Gap or Phe
  misc_feature (1315)..(1315): location 1315 can be Asn or a Gap
  misc_feature (1316)..(1316): location 1316 can be a Gap or Asp
  misc_feature (1317)..(1317): location 1317 can be Ile or a Gap
  misc_feature (1318)..(1318): location 1318 can be a Gap or Gly
  misc_feature (1319)..(1319): location 1319 can be a Gap or Asp
  misc_feature (1320)..(1320): location 1320 can be a Gap or Arg
  misc_feature (1321)..(1321): location 1321 can be a Gap or Glu
  misc_feature (1322)..(1322): location 1322 can be a Gap or Thr
  misc_feature (1323)..(1323): location 1323 can be a Gap or Ala
  misc_feature (1324)..(1324): location 1324 can be a Gap or Leu
  misc_feature (1325)..(1325): location 1325 can be a Gap or Arg
  misc_feature (1326)..(1326): location 1326 can be Ile or a Gap
  misc_feature (1327)..(1327): location 1327 can be a Gap or Lys
  misc_feature (1328)..(1328): location 1328 can be a Gap or Glu
  misc_feature (1329)..(1329): location 1329 can be a Gap or Met
  misc_feature (1330)..(1330): location 1330 can be a Gap or Thr
  misc_feature (1331)..(1331): location 1331 can be Asn or a Gap
  misc_feature (1332)..(1332): location 1332 can be a Gap or Val
  misc_feature (1333)..(1333): location 1333 can be a Gap or Lys
  misc_feature (1334)..(1334): location 1334 can be a Gap or Glu
  misc_feature (1335)..(1335): location 1335 can be a Gap or Val
  misc_feature (1336)..(1336): location 1336 can be a Gap or Lys
  misc_feature (1337)..(1337): location 1337 can be a Gap or Lys
  misc_feature (1338)..(1338): location 1338 can be a Gap or Ser
  misc_feature (1339)..(1339): location 1339 can be a Gap or Gly
  misc_feature (1340)..(1340): location 1340 can be a Gap or His
  misc_feature (1341)..(1341): location 1341 can be a Gap or Ser
  misc_feature (1342)..(1342): location 1342 can be a Gap or Leu
  misc_feature (1343)..(1343): location 1343 can be Ile or a Gap
  misc_feature (1344)..(1344): location 1344 can be a Gap or Glu
  misc_feature (1345)..(1345): location 1345 can be a Gap or Met
  misc_feature (1346)..(1346): location 1346 can be a Gap or Phe
  misc_feature (1347)..(1347): location 1347 can be a Gap or Val
  misc_feature (1348)..(1348): location 1348 can be a Gap or Ala
  misc_feature (1349)..(1349): location 1349 can be a Gap or Arg
  misc_feature (1350)..(1350): location 1350 can be a Gap or Arg
  misc_feature (1351)..(1351): location 1351 can be a Gap or Leu
  misc_feature (1352)..(1352): location 1352 can be a Gap or Phe
  misc_feature (1353)..(1353): location 1353 can be a Gap or Cys
  misc_feature (1354)..(1354): location 1354 can be a Gap or Cys
  misc_feature (1355)..(1355): location 1355 can be Ile or a Gap
  misc_feature (1356)..(1356): location 1356 can be a Gap or Trp
  misc_feature (1357)..(1357): location 1357 can be a Gap or Trp
  misc_feature (1358)..(1358): location 1358 can be a Gap or Trp
  misc_feature (1359)..(1359): location 1359 can be a Gap or Arg
  misc_feature (1360)..(1360): location 1360 can be a Gap or Leu
  misc_feature (1361)..(1361): location 1361 can be a Gap or Thr
  misc_feature (1362)..(1362): location 1362 can be a Gap or Thr
  misc_feature (1363)..(1363): location 1363 can be a Gap or Val
  misc_feature (1364)..(1364): location 1364 can be a Gap or Leu
  misc_feature (1365)..(1365): location 1365 can be a Gap or Ser
  misc_feature (1366)..(1366): location 1366 can be a Gap or Thr
  misc_feature (1367)..(1367): location 1367 can be a Gap or Ser
  misc_feature (1368)..(1368): location 1368 can be a Gap or Thr
  misc_feature (1369)..(1369): location 1369 can be a Gap or Lys
  misc_feature (1370)..(1370): location 1370 can be a Gap or Ser
  misc_feature (1371)..(1371): location 1371 can be a Gap or Lys
  misc_feature (1372)..(1372): location 1372 can be a Gap or Thr
  misc_feature (1373)..(1373): location 1373 can be a Gap or Ala
  misc_feature (1374)..(1374): location 1374 can be a Gap or Glu
  misc_feature (1375)..(1375): location 1375 can be a Gap or Cys
  misc_feature (1376)..(1376): location 1376 can be a Gap or Arg
  misc_feature (1377)..(1377): location 1377 can be a Gap or Pro
  misc_feature (1378)..(1378): location 1378 can be a Gap or Val or Met
  misc_feature (1379)..(1379): location 1379 can be a Gap or Val or Asp
  misc_feature (1380)..(1380): location 1380 can be a Gap or Glu or Met
  misc_feature (1381)..(1381): location 1381 can be a Gap or Val or Glu
  misc_feature (1382)..(1382): location 1382 can be a Gap or Ser or Thr
  misc_feature (1383)..(1383): location 1383 can be a Gap or Thr or Gly
  misc_feature (1384)..(1384): location 1384 can be a Gap or Asp or Gly
  misc_feature (1385)..(1385): location 1385 can be a Gap or Val or Pro
  misc_feature (1386)..(1386): location 1386 can be a Gap or Gly
  misc_feature (1387)..(1387): location 1387 can be a Gap or Trp or Lys
  misc_feature (1388)..(1388): location 1388 can be a Gap or Leu or Gly
  misc_feature (1389)..(1389): location 1389 can be a Gap or Leu or Cys
  misc_feature (1390)..(1390): location 1390 can be a Gap or Val or Arg
  misc_feature (1391)..(1391): location 1391 can be a Gap or Lys or Gly
  misc_feature (1392)..(1392): location 1392 can be a Gap or Trp or His
  misc_feature (1393)..(1393): location 1393 can be a Gap or Ser or Gly
  misc_feature (1394)..(1394): location 1394 can be a Gap or Lys or Leu
  misc_feature (1395)..(1395): location 1395 can be a Gap or Val or Ser
  misc_feature (1396)..(1396): location 1396 can be a Gap or Gln or Arg
  misc_feature (1397)..(1397): location 1397 can be a Gap or Val or Glu
  misc_feature (1398)..(1398): location 1398 can be a Gap or Pro or Gly
  misc_feature (1399)..(1399): location 1399 can be Ile or a Gap or Pro
  misc_feature (1400)..(1400): location 1400 can be a Gap or Ala or Arg
  misc_feature (1401)..(1401): location 1401 can be a Gap or Ala or Ser
  misc_feature (1402)..(1402): location 1402 can be a Gap or Pro or Gly
  misc_feature (1403)..(1403): location 1403 can be a Gap or Phe or Gly
  misc_feature (1404)..(1404): location 1404 can be a Gap or Val or Pro
  misc_feature (1405)..(1405): location 1405 can be a Gap or Glu or Arg
  misc_feature (1406)..(1406): location 1406 can be a Gap or Lys or Leu
  misc_feature (1407)..(1407): location 1407 can be a Gap or Ala or Arg
  misc_feature (1408)..(1408): location 1408 can be a Gap or Pro
  misc_feature (1409)..(1409): location 1409 can be a Gap or Ala or Gln
  misc_feature (1410)..(1410): location 1410 can be a Gap or Thr or Gly
  misc_feature (1411)..(1411): location 1411 can be a Gap or Asp or Cys
  misc_feature (1412)..(1412): location 1412 can be a Gap or Gln or Leu
  misc_feature (1413)..(1413): location 1413 can be a Gap or Val or Glu
  misc_feature (1414)..(1414): location 1414 can be a Gap or Arg
  misc_feature (1415)..(1415): location 1415 can be a Gap or Ala or Thr
  misc_feature (1416)..(1416): location 1416 can be a Gap or Ser or Gly
  misc_feature (1417)..(1417): location 1417 can be a Gap or Asp or Thr
  misc_feature (1418)..(1418): location 1418 can be a Gap or Glu or Arg
  misc_feature (1419)..(1419): location 1419 can be a Gap or Met or Arg or Thr
  misc_feature (1420)..(1420): location 1420 can be a Gap or Leu or Ala or Arg or His
  misc_feature (1421)..(1421): location 1421 can be a Gap or Val or Glu or Ala or Arg or Thr
  misc_feature (1422)..(1422): location 1422 can be a Gap or Asp or Ala or Ser
  misc_feature (1423)..(1423): location 1423 can be a Gap or Ala or Ser
  misc_feature (1424)..(1424): location 1424 can be a Gap or Asp or His or Cys or Gly
  misc_feature (1425)..(1425): location 1425 can be a Gap or Trp or Ala or Arg or Met
  misc_feature (1426)..(1426): location 1426 can be Ile or a Gap or Val or Pro or Ser
  misc_feature (1427)..(1427): location 1427 can be a Gap or Leu or Gly
  misc_feature (1428)..(1428): location 1428 can be a Gap or Lys or Glu or Leu or Thr or Gly
  misc_feature (1429)..(1429): location 1429 can be Ile or a Gap or Glu or Leu
  misc_feature (1430)..(1430): location 1430 can be Ile or Asn or a Gap or Asp or Glu or Cys
  misc_feature (1431)..(1431): location 1431 can be a Gap or Phe or His or Ser or Gly
  misc_feature (1432)..(1432): location 1432 can be a Gap or Glu or Leu
  misc_feature (1433)..(1433): location 1433 can be Ile or a Gap or Val or Ala or Gly
  misc_feature (1434)..(1434): location 1434 can be a Gap or Pro or Leu or Arg
  misc_feature (1435)..(1435): location 1435 can be a Gap or Val or Gly
  misc_feature (1436)..(1436): location 1436 can be a Gap or Leu
  misc_feature (1437)..(1437): location 1437 can be a Gap or Phe or Arg
  misc_feature (1438)..(1438): location 1438 can be a Gap or Ala or Phe
  misc_feature (1439)..(1439): location 1439 can be a Gap or Glu or Leu
  misc_feature (1440)..(1440): location 1440 can be a Gap or Asp or Gly
  misc_feature (1441)..(1441): location 1441 can be Asn or a Gap or Thr
  misc_feature (1442)..(1442): location 1442 can be a Gap or Val or Arg
  misc_feature (1443)..(1443): location 1443 can be Ile or a Gap or Pro
  misc_feature (1444)..(1444): location 1444 can be a Gap or Ala or Leu
  misc_feature (1445)..(1445): location 1445 can be a Gap or Lys or Ser
  misc_feature (1446)..(1446): location 1446 can be a Gap or Phe or Thr
  misc_feature (1447)..(1447): location 1447 can be a Gap or Asp
  misc_feature (1448)..(1448): location 1448 can be Ile or a Gap or Leu
  misc_feature (1449)..(1449): location 1449 can be a Gap or Ser or Arg
  misc_feature (1450)..(1450): location 1450 can be a Gap or Pro or Ala or Met
  misc_feature (1451)..(1451): location 1451 can be a Gap or Tyr or Met or Ser
  misc_feature (1452)..(1452): location 1452 can be a Gap or Ser
  misc_feature (1453)..(1453): location 1453 can be a Gap or Asp or Ser or Gly
  misc_feature (1454)..(1454): location 1454 can be a Gap or Leu or Ser or Gly
  misc_feature (1455)..(1455): location 1455 can be a Gap or Ala or Ser or Thr
  misc_feature (1456)..(1456): location 1456 can be Ile or a Gap or Val
  misc_feature (1457)..(1457): location 1457 can be a Gap or Leu or Arg
  misc_feature (1458)..(1458): location 1458 can be a Gap or Lys or Ala or Met or Arg or Gly
  misc_feature (1459)..(1459): location 1459 can be a Gap or Val or Ala or Leu or Met
  misc_feature (1460)..(1460): location 1460 can be a Gap or Ala or Gln or Ser
  misc_feature (1461)..(1461): location 1461 can be a Gap or Glu or Ala or Arg or Cys or Gly
  misc_feature (1462)..(1462): location 1462 can be a Gap or Glu or Ala or Gln or Phe or Met
  misc_feature (1463)..(1463): location 1463 can be a Gap or Val or Asp or Gln or Cys
  misc_feature (1464)..(1464): location 1464 can be a Gap or Ile or Val or Leu or Ala or Cys
  misc_feature (1465)..(1465): location 1465 can be a Gap or Asp or Gln or His or Thr
  misc_feature (1466)..(1466): location 1466 can be a Gap or Lys or Gln or Leu
  misc_feature (1467)..(1467): location 1467 can be a Gap or Val or Ala
  misc_feature (1468)..(1468): location 1468 can be a Gap or Gln
  misc_feature (1469)..(1469): location 1469 can be a Gap or Asn or Ser
  misc_feature (1470)..(1470): location 1470 can be a Gap or Leu
  misc_feature (1471)..(1471): location 1471 can be a Gap or Ile
  misc_feature (1472)..(1472): location 1472 can be a Gap or Glu or Leu or His
  misc_feature (1473)..(1473): location 1473 can be a Gap or Arg or Cys
  misc_feature (1474)..(1474): location 1474 can be a Gap or Cys
  misc_feature (1475)..(1475): location 1475 can be Leu or Met
  misc_feature (1476)..(1476): location 1476 can be Ile or Gln
  misc_feature (1477)..(1477): location 1477 can be Val or Leu or Met
  misc_feature (1478)..(1478): location 1478 can be Tyr
  misc_feature (1479)..(1479): location 1479 can be Phe or Met
  misc_feature (1480)..(1480): location 1480 can be Asn or Asp or Pro or Ser
  misc_feature (1481)..(1481): location 1481 can be Lys or Gln or Ser
  misc_feature (1482)..(1482): location 1482 can be a Gap or Lys
  misc_feature (1483)..(1483): location 1483 can be a Gap or Glu
  misc_feature (1484)..(1484): location 1484 can be a Gap or Val
  misc_feature (1485)..(1485): location 1485 can be a Gap or Ile or Val
  misc_feature (1486)..(1486): location 1486 can be a Gap or Asp or Glu
  misc_feature (1487)..(1487): location 1487 can be a Gap or Ala or Thr
  misc_feature (1488)..(1488): location 1488 can be a Gap or Leu
  misc_feature (1489)..(1489): location 1489 can be a Gap or Leu or Ser
  misc_feature (1490)..(1490): location 1490 can be a Gap or Glu or Ala or Leu or Phe or His or Arg
  misc_feature (1491)..(1491): location 1491 can be a Gap or Glu or Gln or His
  misc_feature (1492)..(1492): location 1492 can be a Gap or Ala or Ser
  misc_feature (1493)..(1493): location 1493 can be a Gap or Lys or Arg
  misc_feature (1494)..(1494): location 1494 can be a Gap or Ile or Leu
  misc_feature (1495)..(1495): location 1495 can be a Gap or Glu
  misc_feature (1496)..(1496): location 1496 can be a Gap or Pro
  misc_feature (1497)..(1497): location 1497 can be a Gap or Ser or Cys or Gly
  misc_feature (1498)..(1498): location 1498 can be a Gap or Ile or Val or Phe
  misc_feature (1499)..(1499): location 1499 can be Glu or Thr
  misc_feature (1500)..(1500): location 1500 can be Glu or Leu or Gln
  misc_feature (1501)..(1501): location 1501 can be Ile or Leu or His or Thr
  misc_feature (1502)..(1502): location 1502 can be Val
  misc_feature (1503)..(1503): location 1503 can be Trp
  misc_feature (1504)..(1504): location 1504 can be Gln or Arg
  misc_feature (1505)..(1505): location 1505 can be Lys or Gln or Arg
  misc_feature (1506)..(1506): location 1506 can be Leu
  misc_feature (1507)..(1507): location 1507 can be Glu
  misc_feature (1508)..(1508): location 1508 can be Glu or Gln or His
  misc_feature (1509)..(1509): location 1509 can be Asn or Glu or Gln
  misc_feature (1510)..(1510): location 1510 can be Asn
  misc_feature (1511)..(1511): location 1511 can be Glu or Pro or Arg
  misc_feature (1512)..(1512): location 1512 can be Asp or Glu or Leu
  misc_feature (1513)..(1513): location 1513 can be Phe
  misc_feature (1514)..(1514): location 1514 can be Phe
  misc_feature (1515)..(1515): location 1515 can be Asn or Lys
  misc_feature (1516)..(1516): location 1516 can be Ala
  misc_feature (1517)..(1517): location 1517 can be Tyr
  misc_feature (1518)..(1518): location 1518 can be Tyr or Asp
  misc_feature (1519)..(1519): location 1519 can be Val or Ala or Leu or Met
  misc_feature (1520)..(1520): location 1520 can be Arg
  misc_feature (1521)..(1521): location 1521 can be Leu
  misc_feature (1522)..(1522): location 1522 can be Val or Met
  misc_feature (1523)..(1523): location 1523 can be Val or Leu
  misc_feature (1524)..(1524): location 1524 can be Lys or Met
  misc_feature (1525)..(1525): location 1525 can be Asn or Gln or His or Thr
  misc_feature (1526)..(1526): location 1526 can be Gln
  misc_feature (1527)..(1527): location 1527 can be Ile
  misc_feature (1528)..(1528): location 1528 can be Asn or Val or Met or Thr
  misc_feature (1529)..(1529): location 1529 can be Val or Xaa or Glu or Gln or Ala or Ser
  misc_feature (1530)..(1530): location 1530 can be Tyr or Phe
  misc_feature (1531)..(1531): location 1531 can be Asn or Asp
  misc_feature (1532)..(1532): location 1532 can be Asn or Lys or Glu or Arg
  misc_feature (1533)..(1533): location 1533 can be Leu or Phe
  misc_feature (1534)..(1534): location 1534 can be Leu
  misc_feature (1535)..(1535): location 1535 can be Asp or Glu or Ala or Gln or Arg
  misc_feature (1536)..(1536): location 1536 can be Asp or Xaa or Gln or His
  misc_feature (1537)..(1537): location 1537 can be a Gap or Gln
  misc_feature (1538)..(1538): location 1538 can be Ile or Tyr or Val or Leu or Phe or His or Cys
  misc_feature (1539)..(1539): location 1539 can be Asn or Glu or Gln or Arg or His
  misc_feature (1540)..(1540): location 1540 can be Ile or Val or Leu or His
  misc_feature (1541)..(1541): location 1541 can be Ile or Met
  misc_feature (1542)..(1542): location 1542 can be a Gap or Asn or Gln or Arg or Cys or Thr
  misc_feature (1543)..(1543): location 1543 can be Lys or Gln
  misc_feature (1544)..(1544): location 1544 can be Asp or Glu or Leu or Met
  misc_feature (1545)..(1545): location 1545 can be Tyr or Pro or Gln or Phe or His
  misc_feature (1546)..(1546): location 1546 can be Xaa or Pro or Ser or His
  misc_feature (1547)..(1547): location 1547 can be Tyr or Gln or Pro or Ser or Gly or Thr
  misc_feature (1548)..(1548): location 1548 can be Ala or Thr or Gly
  misc_feature (1549)..(1549): location 1549 can be Ile or Val or Leu or Pro or Ser or Met or Gly
  misc_feature (1550)..(1550): location 1550 can be a Gap or Pro or Ala or Ser or Thr
  misc_feature (1551)..(1551): location 1551 can be Ile or Pro or Leu or Ala or Ser
  misc_feature (1552)..(1552): location 1552 can be Val or Leu or Met or Thr
  misc_feature (1553)..(1553): location 1553 can be Pro or Gln or Arg or Ser
  misc_feature (1554)..(1554): location 1554 can be a Gap or Asn or Asp or Pro or Met or Ser or Thr
  misc_feature (1555)..(1555): location 1555 can be a Gap or Ala or Thr
  misc_feature (1556)..(1556): location 1556 can be a Gap or Ala or Leu or Ser or Thr
  misc_feature (1557)..(1557): location 1557 can be Tyr or Pro or Ser or Arg or Thr
  misc_feature (1558)..(1558): location 1558 can be Asn or Gln
  misc_feature (1559)..(1559): location 1559 can be Trp or Asp or Gly
  misc_feature (1560)..(1560): location 1560 can be Pro or Ser
  misc_feature (1561)..(1561): location 1561 can be Asn or Asp or His
  misc_feature (1562)..(1562): location 1562 can be Ile or Val or Leu or Met or Ser or Thr
  misc_feature (1563)..(1563): location 1563 can be Asn or Pro or Gln or Ser or Gly or Thr
  misc_feature (1564)..(1564): location 1564 can be a Gap or Ala or Pro or Leu or Met or Ser or Thr
  misc_feature (1565)..(1565): location 1565 can be a Gap or Tyr or Val or Leu or Phe or Ser
  misc_feature (1566)..(1566): location 1566 can be Asn or a Gap or Lys or Xaa or Ser or Thr
  misc_feature (1567)..(1567): location 1567 can be a Gap or Ser
  misc_feature (1568)..(1568): location 1568 can be a Gap or Leu
  misc_feature (1569)..(1569): location 1569 can be a Gap or Pro
  misc_feature (1570)..(1570): location 1570 can be Asn or a Gap or Ser
  misc_feature (1571)..(1571): location 1571 can be a Gap or Ser
  misc_feature (1572)..(1572): location 1572 can be Asn or a Gap
  misc_feature (1573)..(1573): location 1573 can be a Gap or Gly
  misc_feature (1574)..(1574): location 1574 can be a Gap or Ser
  misc_feature (1575)..(1575): location 1575 can be a Gap or His
  misc_feature (1576)..(1576): location 1576 can be Ile or a Gap
  misc_feature (1577)..(1577): location 1577 can be a Gap or Pro
  misc_feature (1578)..(1578): location 1578 can be Ile or a Gap or Ala
  misc_feature (1579)..(1579): location 1579 can be Ile or a Gap or Leu or Met
  misc_feature (1580)..(1580): location 1580 can be a Gap or Asn or Pro
  misc_feature (1581)..(1581): location 1581 can be a Gap or Lys or Glu or Gln
  misc_feature (1582)..(1582): location 1582 can be a Gap or Asn or Asp or Lys or Gln or Ala or Thr
  misc_feature (1583)..(1583): location 1583 can be Ala or Gln or His or Thr or a Gap or Val or Pro or Leu or Met or Ser
  misc_feature (1584)..(1584): location 1584 can be Ala or Cys or a Gap or Pro or Leu
  misc_feature (1585)..(1585): location 1585 can be Cys or a Gap or Leu or Phe or Gly
  misc_feature (1586)..(1586): location 1586 can be Gln or a Gap or Tyr or Leu or Phe
  misc_feature (1587)..(1587): location 1587 can be Ile or Gln or Ala or Thr or a Gap or Glu or Pro or Ser
  misc_feature (1588)..(1588): location 1588 can be Asp or Ala or Arg or a Gap or Trp or Glu or Ser
  misc_feature (1589)..(1589): location 1589 can be Asp or Lys or Thr or a Gap or Glu or Pro or Ser
  misc_feature (1590)..(1590): location 1590 can be Ile or Ala or Arg or His or Thr or a Gap or Glu or Leu or Phe
  misc_feature (1591)..(1591): location 1591 can be Thr or a Gap or Pro or Ser or Gly
  misc_feature (1592)..(1592): location 1592 can be Asp or Gln or a Gap or Pro or Ser or Met or Gly
  misc_feature (1593)..(1593): location 1593 can be Asn or Ile or Gln or Thr or a Gap or Pro or Ser
  misc_feature (1594)..(1594): location 1594 can be Ala or a Gap or Phe or Ser
  misc_feature (1595)..(1595): location 1595 can be Ile or Cys or a Gap or Leu or Ser or Met
  misc_feature (1596)..(1596): location 1596 can be Lys or Gln or a Gap or Pro
  misc_feature (1597)..(1597): location 1597 can be Asn or Asp or a Gap or Pro or Ser
  misc_feature (1598)..(1598): location 1598 can be Asn or Asp or a Gap or Glu or Ser or Gly
  misc_feature (1599)..(1599): location 1599 can be Asn or Ile or a Gap or Val or Leu or Phe or Ser
  misc_feature (1600)..(1600): location 1600 can be Ala or a Gap or Trp or Leu or Met
  misc_feature (1601)..(1601): location 1601 can be Gln or Arg or His or Cys or a Gap or Pro or Ser
  misc_feature (1602)..(1602): location 1602 can be His or a Gap
  misc_feature (1603)..(1603): location 1603 can be Ala or His or a Gap or Pro
  misc_feature (1604)..(1604): location 1604 can be Ile or a Gap or Val or Met
  misc_feature (1605)..(1605): location 1605 can be Asp or Ala or a Gap or Pro
  misc_feature (1606)..(1606): location 1606 can be Asn or Xaa or a Gap or Ser
  misc_feature (1607)..(1607): location 1607 can be Arg or a Gap or Ser or Gly
  misc_feature (1608)..(1608): location 1608 can be Asn or a Gap or Leu or Ser or Gly
  misc_feature (1609)..(1609): location 1609 can be a Gap or Ser
  misc_feature (1610)..(1610): location 1610 can be Asn or Arg or a Gap or Ser
  misc_feature (1611)..(1611): location 1611 can be Ala or a Gap or Val or Pro or Ser or Gly
  misc_feature (1612)..(1612): location 1612 can be Ile or a Gap or Val or Tyr or Phe
  misc_feature (1613)..(1613): location 1613 can be Asn or Ile or a Gap or Val or Leu
  misc_feature (1614)..(1614): location 1614 can be Asn or Asp or a Gap
  misc_feature (1615)..(1615): location 1615 can be Asp or Arg or a Gap or Gly
  misc_feature (1616)..(1616): location 1616 can be Ala or Thr or a Gap or Ser or Gly
  misc_feature (1617)..(1617): location 1617 can be Gln or a Gap or Pro or Ser
  misc_feature (1618)..(1618): location 1618 can be Asn or Ala or Thr or a Gap or Ser
  misc_feature (1619)..(1619): location 1619 can be Ile or Asp or Thr or a Gap or Leu or Ser or Gly
  misc_feature (1620)..(1620): location 1620 can be Asn or Asp or Gln or His or a Gap
  misc_feature (1621)..(1621): location 1621 can be Gln or Thr or a Gap or Met
  misc_feature (1622)..(1622): location 1622 can be Asn or Cys or a Gap or Val or Leu or Phe or Ser
  misc_feature (1623)..(1623): location 1623 can be Ile or a Gap or Val or Leu or Met or Gly
  misc_feature (1624)..(1624): location 1624 can be Asn or His or a Gap or Tyr or Pro or Met
  misc_feature (1625)..(1625): location 1625 can be Ala or Arg or Thr or a Gap or Ser or Gly
  misc_feature (1626)..(1626): location 1626 can be Asn or Ala or Gln or a Gap or Tyr or Ser or Gly
  misc_feature (1627)..(1627): location 1627 can be Ile or Lys or a Gap or Val or Trp
  misc_feature (1628)..(1628): location 1628 can be Asn or Lys or Asp or a Gap or Val
  misc_feature (1629)..(1629): location 1629 can be Ile or Ala or a Gap or Val or Leu or Phe or Met
  misc_feature (1630)..(1630): location 1630 can be Gln or His or a Gap or Ser
  misc_feature (1631)..(1631): location 1631 can be Ala or Thr or a Gap or Val or Ser or Gly
  misc_feature (1632)..(1632): location 1632 can be His or a Gap or Leu or Gly
  misc_feature (1633)..(1633): location 1633 can be Ala or His or a Gap or Pro or Phe or Ser or Gly
  misc_feature (1634)..(1634): location 1634 can be Asn or Lys or Arg or a Gap or Ser or Gly
  misc_feature (1635)..(1635): location 1635 can be Gln or Arg or a Gap or Val or Ser or Gly
  misc_feature (1636)..(1636): location 1636 can be Ile or a Gap or Val or Met
  misc_feature (1637)..(1637): location 1637 can be Asn or Asp or a Gap
  misc_feature (1638)..(1638): location 1638 can be Ala or a Gap or Pro or Gly
  misc_feature (1639)..(1639): location 1639 can be a Gap or Pro or Ser
  misc_feature (1640)..(1640): location 1640 can be Asn or Ala or Thr or a Gap or Val or Pro or Ser
  misc_feature (1641)..(1641): location 1641 can be Asn or a Gap or Ser
  misc_feature (1642)..(1642): location 1642 can be a Gap or Val or Leu or Ser or Met
  misc_feature (1643)..(1643): location 1643 can be Gln or a Gap or Leu
  misc_feature (1644)..(1644): location 1644 can be Xaa or Ala or Thr or a Gap or Pro or Ser
  misc_feature (1645)..(1645): location 1645 can be Asp or Ala or a Gap or Val or Leu or Ser
  misc_feature (1646)..(1646): location 1646 can be Gln or His or a Gap
  misc_feature (1647)..(1647): location 1647 can be Asn or Lys or Ala or Thr or a Gap or Ser
  misc_feature (1648)..(1648): location 1648 can be Ala or Thr or a Gap or Pro or Ser
  misc_feature (1649)..(1649): location 1649 can be Asn or Ala or Thr or a Gap
  misc_feature (1650)..(1650): location 1650 can be Ala or a Gap or Val or Ser or Met or Gly
  misc_feature (1651)..(1651): location 1651 can be a Gap or Val or Pro or Gly
  misc_feature (1652)..(1652): location 1652 can be Gln or Arg or a Gap or Leu or Met
  misc_feature (1653)..(1653): location 1653 can be Ile or a Gap or Tyr or Phe or Met
  misc_feature (1654)..(1654): location 1654 can be Asn or Gln or a Gap or Gly
  misc_feature (1655)..(1655): location 1655 can be a Gap or Val or Gly
  misc_feature (1656)..(1656): location 1656 can be Ile or Asp or His or a Gap or Glu or Met
  misc_feature (1657)..(1657): location 1657 can be Asn or Asp or a Gap
  misc_feature (1658)..(1658): location 1658 can be a Gap or Glu or Gly
  misc_feature (1659)..(1659): location 1659 can be Ala or Thr or a Gap or Gly
  misc_feature (1660)..(1660): location 1660 can be a Gap or Ser or Gly
  misc_feature (1661)..(1661): location 1661 can be Ala or a Gap
  misc_feature (1662)..(1662): location 1662 can be Thr or a Gap or Met
  misc_feature (1663)..(1663): location 1663 can be Ile or Thr or a Gap
  misc_feature (1664)..(1664): location 1664 can be Lys or a Gap
  misc_feature (1665)..(1665): location 1665 can be Ala or Thr or a Gap or Ser
  misc_feature (1666)..(1666): location 1666 can be a Gap or Glu
  misc_feature (1667)..(1667): location 1667 can be Ala or Thr or a Gap or Pro or Phe or Ser
  misc_feature (1668)..(1668): location 1668 can be Asp or Ala or Cys or a Gap or Ser or Gly
  misc_feature (1669)..(1669): location 1669 can be a Gap or Tyr or Phe
  misc_feature (1670)..(1670): location 1670 can be Gln or Thr or a Gap or Ser
  misc_feature (1671)..(1671): location 1671 can be Asn or a Gap or Ser or Gly
  misc_feature (1672)..(1672): location 1672 can be Asn or Cys or a Gap or Pro
  misc_feature (1673)..(1673): location 1673 can be Ala or a Gap or Pro or Ser or Gly
  misc_feature (1674)..(1674): location 1674 can be Asn or Asp or a Gap or Glu or Pro or Ser
  misc_feature (1675)..(1675): location 1675 can be a Gap or Tyr or Phe
  misc_feature (1676)..(1676): location 1676 can be Ala or a Gap or Met or Gly
  misc_feature (1677)..(1677): location 1677 can be a Gap or Tyr or Leu or Phe
  misc_feature (1678)..(1678): location 1678 can be Cys or a Gap or Ser or Gly
  misc_feature (1679)..(1679): location 1679 can be Asn or Thr or a Gap or Gly
  misc_feature (1680)..(1680): location 1680 can be Asn or Asp or a Gap or Glu
  misc_feature (1681)..(1681): location 1681 can be Asn or Ala or Arg or Thr or a Gap or Ser or Gly
  misc_feature (1682)..(1682): location 1682 can be Asn or Ala or Thr or a Gap or Val
  misc_feature (1683)..(1683): location 1683 can be Ala or a Gap or Tyr or Val or Phe
  misc_feature (1684)..(1684): location 1684 can be a Gap or Leu
  misc_feature (1685)..(1685): location 1685 can be a Gap or Glu
  misc_feature (1686)..(1686): location 1686 can be Ala or Thr or a Gap or Pro or Ser or Gly
  misc_feature (1687)..(1687): location 1687 can be Gln or Arg or His or Cys or a Gap
  misc_feature (1688)..(1688): location 1688 can be Gln or a Gap or Pro or Ser
  misc_feature (1689)..(1689): location 1689 can be Ala or Thr or a Gap or Ser
  misc_feature (1690)..(1690): location 1690 can be Ile or a Gap or Val or Phe
  misc_feature (1691)..(1691): location 1691 can be a Gap or Gly
  misc_feature (1692)..(1692): location 1692 can be Asp or a Gap or Gly
  misc_feature (1693)..(1693): location 1693 can be Ile or Xaa or Ala or Thr or a Gap or Val
  misc_feature (1694)..(1694): location 1694 can be Thr or a Gap or Ser
  misc_feature (1695)..(1695): location 1695 can be Ile or a Gap or Val or Gly
  misc_feature (1696)..(1696): location 1696 can be Ala or Thr or a Gap or Pro or Gly
  misc_feature (1697)..(1697): location 1697 can be a Gap or Gly
  misc_feature (1698)..(1698): location 1698 can be Asn or a Gap or Ser
  misc_feature (1699)..(1699): location 1699 can be a Gap or Phe
  misc_feature (1700)..(1700): location 1700 can be Thr or a Gap or Ser
  misc_feature (1701)..(1701): location 1701 can be Asn or a Gap or Ser
  misc_feature (1702)..(1702): location 1702 can be a Gap or Val or Ser
  misc_feature (1703)..(1703): location 1703 can be Asp or a Gap or Glu
  misc_feature (1704)..(1704): location 1704 can be a Gap or Leu or Ser
  misc_feature (1705)..(1705): location 1705 can be Asn or a Gap or Ser
  misc_feature (1706)..(1706): location 1706 can be Asn or a Gap or Ser or Gly
  misc_feature (1707)..(1707): location 1707 can be Gln or His or a Gap
  misc_feature (1708)..(1708): location 1708 can be a Gap or Pro or Ser
  misc_feature (1709)..(1709): location 1709 can be a Gap or Leu
  misc_feature (1710)..(1710): location 1710 can be Asn or Asp or a Gap or Ser or Gly
  misc_feature (1711)..(1711): location 1711 can be Asp or a Gap or Glu
  misc_feature (1712)..(1712): location 1712 can be Ala or Thr or a Gap or Val or Pro or Ser
  misc_feature (1713)..(1713): location 1713 can be Ile or a Gap or Val or Leu
  misc_feature (1714)..(1714): location 1714 can be a Gap or Val or Leu or Met
  misc_feature (1715)..(1715): location 1715 can be Asp or a Gap or Glu
  misc_feature (1716)..(1716): location 1716 can be Ile or Gln or Ala or a Gap or Val or Pro or Met
  misc_feature (1717)..(1717): location 1717 can be Asp or a Gap or Glu or Gly
  misc_feature (1718)..(1718): location 1718 can be Ala or Thr or a Gap or Ser
  misc_feature (1719)..(1719): location 1719 can be a Gap or Pro or Ser
  misc_feature (1720)..(1720): location 1720 can be Thr or a Gap or Ser
  misc_feature (1721)..(1721): location 1721 can be a Gap or Tyr or Phe
  misc_feature (1722)..(1722): location 1722 can be a Gap or Ser or Gly
  misc_feature (1723)..(1723): location 1723 can be a Gap or Phe or Ser
  misc_feature (1724)..(1724): location 1724 can be a Gap or Leu
  misc_feature (1725)..(1725): location 1725 can be Asn or a Gap or Ser or Gly
  misc_feature (1726)..(1726): location 1726 can be Gln or a Gap
  misc_feature (1727)..(1727): location 1727 can be Ile or a Gap or Leu or Met
  misc_feature (1728)..(1728): location 1728 can be a Gap or Pro
  misc_feature (1729)..(1729): location 1729 can be Gln or Arg or Cys or a Gap
  misc_feature (1730)..(1730): location 1730 can be Asn or a Gap or Ser
  misc_feature (1731)..(1731): location 1731 can be a Gap or Phe
  misc_feature (1732)..(1732): location 1732 can be Ile or a Gap or Met or Ser
  misc_feature (1733)..(1733): location 1733 can be a Gap or Leu or Phe
  misc_feature (1734)..(1734): location 1734 can be a Gap or Pro or Ser
  misc_feature (1735)..(1735): location 1735 can be Xaa or a Gap
  misc_feature (1736)..(1736): location 1736 can be Asp or a Gap
  misc_feature (1737)..(1737): location 1737 can be a Gap or Trp or Leu
  misc_feature (1738)..(1738): location 1738 can be Ala or Thr or a Gap or Pro
  misc_feature (1739)..(1739): location 1739 can be Asp or Ala or a Gap or Glu
  misc_feature (1740)..(1740): location 1740 can be Asp or Cys or a Gap
  misc_feature (1741)..(1741): location 1741 can be a Gap or Phe
  misc_feature (1742)..(1742): location 1742 can be Asn or a Gap or Ser
  misc_feature (1743)..(1743): location 1743 can be Gln or His or a Gap
  misc_feature (1744)..(1744): location 1744 can be Asn or a Gap or Ser
  misc_feature (1745)..(1745): location 1745 can be Ala or Thr or a Gap or Ser
  misc_feature (1746)..(1746): location 1746 can be Asp or a Gap or Glu
  misc_feature (1747)..(1747): location 1747 can be Ile or a Gap
  misc_feature (1748)..(1748): location 1748 can be Thr or a Gap or Leu or Phe
  misc_feature (1749)..(1749): location 1749 can be Asp or a Gap or Glu
  misc_feature (1750)..(1750): location 1750 can be Asn or Thr or a Gap or Ser
  misc_feature (1751)..(1751): location 1751 can be a Gap or Tyr
  misc_feature (1752)..(1752): location 1752 can be Asp or a Gap or Glu or Ser or Gly
  misc_feature (1753)..(1753): location 1753 can be Lys or Arg or a Gap or Ser or Gly
  misc_feature (1754)..(1754): location 1754 can be a Gap or Ser
  misc_feature (1755)..(1755): location 1755 can be a Gap or Pro
  misc_feature (1756)..(1756): location 1756 can be a Gap or Phe
  misc_feature (1757)..(1757): location 1757 can be Ile or a Gap or Leu
  misc_feature (1758)..(1758): location 1758 can be Ala or Thr or a Gap or Val or Leu or Pro
  misc_feature (1759)..(1759): location 1759 can be Ala or Thr or a Gap or Pro or Ser
  misc_feature (1760)..(1760): location 1760 can be Asn or Asp or a Gap or Glu
  misc_feature (1761)..(1761): location 1761 can be Asn or Gln or Ala or Thr or a Gap or Pro
  misc_feature (1762)..(1762): location 1762 can be Asn or a Gap or Glu
  misc_feature (1763)..(1763): location 1763 can be Asn or Thr or a Gap
  misc_feature (1764)..(1764): location 1764 can be Ile or a Gap or Phe
  misc_feature (1765)..(1765): location 1765 can be a Gap or Pro or Leu or Ser
  misc_feature (1766)..(1766): location 1766 can be Asp or a Gap or Glu
  misc_feature (1767)..(1767): location 1767 can be Arg or a Gap or Ser
  misc_feature (1768)..(1768): location 1768 can be Arg or Thr or a Gap or Ser or Gly
  misc_feature (1769)..(1769): location 1769 can be Asp or Ala or a Gap or Glu or Pro or Gly
  misc_feature (1770)..(1770): location 1770 can be Gln or Arg or a Gap or Glu or Gly
  misc_feature (1771)..(1771): location 1771 can be Asp or a Gap or Val or Glu or Gly
  misc_feature (1772)..(1772): location 1772 can be Asn or His or a Gap or Glu
  misc_feature (1773)..(1773): location 1773 can be Ala or His or Thr or a Gap or Tyr
  misc_feature (1774)..(1774): location 1774 can be Gln or a Gap or Glu or Gly
  misc_feature (1775)..(1775): location 1775 can be Ile or Asp or a Gap or Gly
  misc_feature (1776)..(1776): location 1776 can be a Gap or Phe
  misc_feature (1777)..(1777): location 1777 can be a Gap or Met
  misc_feature (1778)..(1778): location 1778 can be a Gap or Glu
  misc_feature (1779)..(1779): location 1779 can be Cys or a Gap
  misc_feature (1780)..(1780): location 1780 can be a Gap or Leu
  misc_feature (1781)..(1781): location 1781 can be Ala or a Gap
  misc_feature (1782)..(1782): location 1782 can be His or a Gap
  misc_feature (1783)..(1783): location 1783 can be a Gap or Leu
  misc_feature (1784)..(1784): location 1784 can be a Gap or Ser
  misc_feature (1785)..(1785): location 1785 can be a Gap or Tyr
  misc_feature (1786)..(1786): location 1786 can be Asn or a Gap
  misc_feature (1787)..(1787): location 1787 can be a Gap or Gly
  misc_feature (1788)..(1788): location 1788 can be Lys or a Gap
  misc_feature (1789)..(1789): location 1789 can be Asn or a Gap
  misc_feature (1790)..(1790): location 1790 can be a Gap or Leu
  misc_feature (1791)..(1791): location 1791 can be Lys or a Gap
  misc_feature (1792)..(1792): location 1792 can be a Gap or Leu
  misc_feature (1793)..(1793): location 1793 can be Asn or a Gap
  misc_feature (1794)..(1794): location 1794 can be His or a Gap
  misc_feature (1795)..(1795): location 1795 can be a Gap or Ser
  misc_feature (1796)..(1796): location 1796 can be a Gap or Gly
  misc_feature (1797)..(1797): location 1797 can be Thr or a Gap
  misc_feature (1798)..(1798): location 1798 can be Arg or a Gap
  misc_feature (1799)..(1799): location 1799 can be Asp or a Gap
  misc_feature (1800)..(1800): location 1800 can be Thr or a Gap
  misc_feature (1801)..(1801): location 1801 can be Arg or a Gap
  misc_feature (1802)..(1802): location 1802 can be Asp or a Gap or Glu or Gly
  misc_feature (1803)..(1803): location 1803 can be Asn or His or a Gap
  misc_feature (1804)..(1804): location 1804 can be Ile or Asn or Lys or Arg or a Gap or Glu or Leu
  misc_feature (1805)..(1805): location 1805 can be Lys or Arg or a Gap
  misc_feature (1806)..(1806): location 1806 can be a Gap or Leu
  misc_feature (1807)..(1807): location 1807 can be Asp or Arg or Cys or a Gap
  misc_feature (1808)..(1808): location 1808 can be Thr or a Gap or Ser
  misc_feature (1809)..(1809): location 1809 can be Ile or a Gap
  misc_feature (1810)..(1810): location 1810 can be a Gap or Ser
  misc_feature (1811)..(1811): location 1811 can be a Gap or Glu or Ser
  misc_feature (1812)..(1812): location 1812 can be a Gap or Gly
  misc_feature (1813)..(1813): location 1813 can be Ile or a Gap or Val or Leu or Phe
  misc_feature (1814)..(1814): location 1814 can be His or a Gap or Ser
  misc_feature (1815)..(1815): location 1815 can be a Gap or Tyr or Phe
  misc_feature (1816)..(1816): location 1816 can be Asp or a Gap or Glu
  misc_feature (1817)..(1817): location 1817 can be Asn or Asp or a Gap
  misc_feature (1818)..(1818): location 1818 can be Ile or a Gap or Phe
  misc_feature (1819)..(1819): location 1819 can be Arg or a Gap or Gly
  misc_feature (1820)..(1820): location 1820 can be a Gap or Ser
  misc_feature (1821)..(1821): location 1821 can be Asn or Asp or a Gap or Glu
  misc_feature (1822)..(1822): location 1822 can be
  unsure (1)..(1821): unsure at all Xaa locations
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXDXXXVQNLIERCLQLYMNQKEVVXTLXXXAKIEPXFTELVWQKLEEENREFFKAYYXRLMXKXQIXXFNXLLEXQXXXMXXXXXXXXXSXXXXXXNGSXXXXXXXXXXXXXXXXXXXXQXXXXXXXXXXXXXXXXXXXXXXXXXXXSXXXXNGXXXXXXXXXXXXXXXXXXXXXDXSXXXLXXXXXXXXXXXXXXXXXXXIKXEXXYXXXXXXXXXXXXXXXEXXXXXGDXXXXXSFSXXXXXXQXLXXXXXXXXXXXXGXLXQXPXNFXXSXDLXXDFSQSXXILXXYXXSPFXXXXXXNFXXSXXXXXXXXXXXXXXXXXXXXXXXXXXXXXXXXXXXXXXXXXXXXXXXXXXXXXX

SEQ ID NO: 19940 - DNA, 12554 bp, Artificial sequence
  pMON93039
agcttgatctcgtcaatttttcccttttgtaattttgtaatttataatttactttcctgtatgcttctaactctgtcgttttaaaattttaataaaatttcagtaggggcttgcccctcctgtcctataaaaaaaagttgacgtgaatagatttcattaagaggttggatgttagtgggatgacatgactattagtaggacgagatgatgtggaaagttagtgggagatgatatggatagtttttgctttcatcgaaaggttggaagttagtatgatgacatggctaatatagatacatagatatagactaccaacatggctgcatgcccccaagctctcccactatatatatctctggtagcacatcatcccaattcacaatgcttacaaaaacccatccatcattttagctgttgatacaaaagagctcgaagggagatctaccgtcttcggtacgcgctcactccgccctctgcctttgttactgccacgtttctctgaatgctctcttgtgtggtgattgctgagagtggtttagctggatctagaattacactctgaaatcgtgttctgcctgtgctgattacttgccgtcctttgtagcagcaaaatatagggacatggtagtacgaaacgaagatagaacctacacagcaatacgagaaatgtgtaatttggtgcttagcggtatttatttaagcacatgttggtgttatagggcacttggattcagaagtttgctgttaatttaggcacaggcttcatactacatgggtcaatagtatagggattcatattataggcgatactataataatttgttcgtctgcagagcttattatttgccaaaattagatattcctattctgtttttgtttgtgtgctgttaaattgttgatcccgatttggcaagtgttccagagcaaaagctggaagctctcgtagtctgagcctctttgctgattcatacaagttatgaccatctacatggatcgtctcaccaagaaatttgtagactgcaggatttttccctgaccggagtgcaccagctgggttccaactgaatttataggcaagcggattgtttgctgcagctggagatggcaatccaccacagtaagatgtaaatgcctttatttttccctttcgtgcatgagcttcatcaatcatcttcattgacatcaagtgatctatgccaggatctaggcccatttcacaaagtatagttacacctgcatctttggcagcttggctcaagtttgacatggattcatcaacatagcttgccgttaccatgtgcttcttcaactctatgcatactcctgcaatggcagcatgaaaactagcaggcagcaagctaattacaacctcaacctgagaaacaagatctgaaaggcttccaatatcagcaacatcaagctgggtagcagttgtattttcaataccatcaactgtctcttctgcatctttttgatacaaagatgccacgataacatgaatttgatctgcatcatggtcatcaacaccataggtacatatgtctgggtaagatgccagaaactcagcagctggccgacagactcttccagctccaaaccggtgctgcctgctagttttcatgctgccattgcaggagtatgcatagagttgaagaagcacatggtaacggcaagctatgttgatgaatccatgtcaaacttgagccaagctgccaaagatgcaggtgtaactatactttgtgaaatgggcctagatcctggcatagatcacttgatgtcaatgaagatgattgatgaagctcatgcacgaaagggaaaaataaaggcatttacatcttactgtggtggattgccatctccagctgcagcaaacaatccgcttgcctataaattcagttggaacccagctggtgcactccggtcagggaaaaatcctgcagtctacaaatttcttggtgagacgatccatgtagatggtcataacttgtatgaatcagcaaagaggctcagactacgagagcttccagcttttgctctggaacacttgccaaatcggaattaacgcctgaaggaataaatataaatgacgaaattttgatgtttatctctgctcctttattgtgaccataagtcaagatcagatgcacttgttttaaatattgttgtctgaagaaataagtactgacagtattttgatgcattgatctgcttgtttgttgtaacaaaatttaaaaataaagagtttcctttttgttgctctccttacctcctgatggtatctagtatctaccaactgacactatattgcttctctttacatacgtatcttgctcgatgccttctccctagtgttgaccagtgttactcacatagtctttgctcatttcattgtaatgcagataccaagcggatccatggtttcgccgacgaatctcctcccggcgcggaagatcacccctgtctcaaatggcggcgcagcgacggcgagcccctcttctccctcggtggccgcacggccacggcgactcccttcaggcctccaatctgtgactggtagagggaaggtttccttggcagccatcactagcacaggtttaacagctaagaccggagtagagcactttggcaccgtgggagtagcaatggtaactccattcacggaaagtggagacatcgatatagctgctggccgcgaggtcgcggcttatctagtcgataaaggcttggattctttggtgctcgcgggcaccactggtgaatccccaacgacaaccgccgctgagaaactagaactgctcaaggccgtgcgtgaggaagtaggggatagggcgaaactaatcgccggtgtcggaaccaataacacgcggacatctgtggaacttgcggaggctgctgcttctgctggcgcagacggccttttagtcgtaactccttattacagtaagccgagccaggagggattgctggcgcacttcggggcaatcgcagcagcaacagaggtgccaatttgcctctacgacattcctggtaggtcaggtattccaattgagtctgataccatgagacgcctgagtgaattacctacgattttggcggtcaaagacgccaaaggggacctggttgcagccacgtcattgatcaaagaaacgggacttgcctggtattcaggcgatgacccactaaaccttgtttggcttgctttgggcggatcaggttttatatccgtaattggacatgcagcccccacagcattaagggagttgtacacaagtttcgaggaaggcgacctggtccgtgcgagggagatcaacgccaaactatcaccgctggtagctgcccagggtcgcttgggtggagtcagcttggcaaaagctgctctgcgtctgcaaggcatcaacgtaggagatcctaggcttccaataatggctccaaatgagcaggaacttgaggctctgcgagaagacatgaaaaaagctggagttctataagaattctgcatgcgtttggacgtatgctcattcaggttggagccaatttggttgatgtgtgtgcgagttcttgcgagtctgatgagacatctctgtattgtgtttctttccccagtgttttctgtacttgtgtaatcggctaatcgccaacagattcggcgatgaataaatgagaaataaattgttctgattttgagtgcaaaaaaaaaggaattgatatcggcgcgttaattaagcggccgcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttgtacactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagtgatcaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcacggtgcaagcagccggcccgcaaccgcccgcaaatcctctggcctttccggaaccgtccgcattcccggcgacaagtcgatctcccaccggtccttcatgttcggcggtctcgcgagcggtgaaacgcgcatcaccggccttctggaaggcgaggacgtcatcaatacgggcaaggccatgcaggcgatgggcgcccgcatccgtaaggaaggcgacacctggatcatcgatggcgtcggcaatggcggcctcctggcgcctgaggcgccgctcgatttcggcaatgccgccacgggctgccgcctgacgatgggcctcgtcggggtctacgatttcgacagcaccttcatcggcgacgcctcgctcacaaagcgcccgatgggccgcgtgttgaacccgctgcgcgaaatgggcgtgcaggtgaaatcggaagacggtgaccgtcttcccgttaccttgcgcgggccgaagacgccgacgccgatcacctaccgcgtgccgatggcctccgcacaggtgaagtccgccgtgctgctcgccggcctcaacacgcccggcatcacgacggtcatcgagccgatcatgacgcgcgatcatacggaaaagatgctgcagggctttggcgccaaccttaccgtcgagacggatgcggacggcgtgcgcaccatccgcctggaaggccgcggcaagctcaccggccaagtcatcgacgtgccgggcgacccgtcctcgacggccttcccgctggttgcggccctgcttgttccgggctccgacgtcaccatcctcaacgtgctgatgaaccccacccgcaccggcctcatcctgacgctgcaggaaatgggcgccgacatcgaagtcatcaacccgcgccttgccggcggcgaagacgtggcggacctgcgcgttcgctcctccacgctgaagggcgtcacggtgccggaagaccgcgcgccttcgatgatcgacgaatatccgattctcgctgtcgccgccgccttcgcggaaggggcgaccgtgatgaacggtctggaagaactccgcgtcaaggaaagcgaccgcctctcggccgtcgccaatggcctcaagctcaatggcgtggattgcgatgagggcgagacgtcgctcgtcgtgcgtggccgccctgacggcaaggggctcggcaacgcctcgggcgccgccgtcgccacccatctcgatcaccgcatcgccatgagcttcctcgtcatgggcctcgtgtcggaaaaccctgtcacggtggacgatgccacgatgatcgccacgagcttcccggagttcatggacctgatggccgggctgggcgcgaagatcgaactctccgatacgaaggctgcctgatgagctcgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatgggggatctcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatccccatca

SEQ ID NO: 19941 - DNA, 9769 bp, Artificial sequence
  pMON82053
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggaccaggtggtaccggcgcgcctcagcagtcgctgtcgttaacccagcggtactcgctgaggcgatcgcgggccctgatcacctgtcgtacagtatttctacatttgatgtgtgatttgtgaagaacatcaaacaaaacaagcactggctttaatatgatgataagtattatggtaattaattaattggcaaaaacaacaatgaagctaaaattttatttattgagccttgcggttaatttcttgtgatgatctttttttttattttctaattatatatagtttcctttgctttgaaatgctaaaggtttgagagagttatgctctttttttcttcctctttcttttttaactttatcatacaaattttgaataaaaatgtgagtacattgagctcatttaaataagcttgatggggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcggaggaccgaaggagctaaccgcttttttgcacaacatgggggatcatgtaactcgccttgatcgttgggaaccggagctgaatgaagccataccaaacgacgagcgtgacaccacgatgcctgcagcatctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgacctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgaccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctaggaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgcggccaccactcgagaagcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagttaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcatggagcttcatctaggccagctactgccaggaagtctagcgggctcagtggcaccgtgcgcatccctggcgataaaagtatttcacacaggagcttcatgttcggaggacttgctagtggagagacgagaatcactggtttgcttgagggcgaagatgttatcaacaccggtaaggcgatgcaagcaatgggtgccagaatccgaaaagagggcgatacgtggatcatcgacggtgttggtaacggaggattgctcgctcccgaagcgccacttgactttgggaacgcagctacggggtgccgtcttactatgggactggtaggcgtgtatgactttgactctaccttcatcggtgacgcgagcctcactaagagaccaatgggacgagtgctgaatcccctgagggagatgggtgtccaggtgaaatctgaggatggtgatcgtcttccggttactctgcgaggccccaagacccccacgccaatcacgtacagggttccgatggcgtcagcacaggtcaagtcagcggtactcctggcgggcctcaacacacctggaatcacaaccgtgattgaacccatcatgactagagaccacacggagaagatgttgcagggtttcggcgctaatctaacggtcgaaaccgacgccgacggcgtgaggacaatccgcttggagggcagaggtaaactgactggccaagtcatcgatgtgcctggagatccctcgtccacagcgtttcccctcgtagctgcgttgctcgtccctggatctgatgtgacgatcctgaatgtcctcatgaatccaactagaaccggcctcatcctcacattgcaggagatgggtgctgacatcgaggttatcaatcctaggttggcaggtggagaggatgtggccgatctgcgcgtgcgttctagtacactcaaaggcgtgaccgtccctgaggatcgcgctccatccatgatcgacgagtaccccattctcgccgttgctgctgcgtttgccgagggcgcaactgtaatgaacggccttgaggagttgagggttaaggagagtgacaggctgtccgcggtggcgaatggcctgaagctaaacggcgtggactgcgacgaaggtgaaacgtcccttgtagtccgtggtcgcccagacgggaaggggttggggaatgcttcgggagctgctgtggcgacgcaccttgatcatagaatcgccatgtcatttctggtgatgggacttgtctccgagaatccggtgaccgttgacgatgctaccatgatcgccacctcctttcctgagttcatggacctcatggcaggcttgggggccaagatcgagctgtctgatactaaggccgcttgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcccacgtgcggaccgcctgcaggccgcgttatcaagctaactgca

SEQ ID NO: 19942 - DNA, 8504 bp, Artificial sequence
  pMON99053
gtaccctcagcagtcgctgtgcgatcgccagcggtactcgctgaggtcgacgtagttagttaattcagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgcggccgccactcgagtggaagctagctttccgatcctacctgtcacttcatcaaaaggacagtagaaaaggaaggtggcacctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgatacttccactgacgtaagggatgacgcacaatcccactatccttcgcaagacccttcctctatataaggaagttcatttcatttggagaggacacgctgaaatcaccagtctctctctacaagatcggggatctctagctagacgatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgatccccaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcgggccactcgagtggtggccgcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatccccatcaagcttggccagcttctgcaggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacagaaaaatttgctacattgtttcacaaacttcaaatattattcatttatttgtcagctttcaaactctttgtttcttgtttgttgattagatctg
